(12) United States Patent
Mack et al.

(10) Patent No.: US 7,189,507 B2
(45) Date of Patent: Mar. 13, 2007

(54) METHODS OF DIAGNOSIS OF OVARIAN CANCER, COMPOSITIONS AND METHODS OF SCREENING FOR MODULATORS OF OVARIAN CANCER

(75) Inventors: David H. Mack, Menlo Park, CA (US); Kurt C. Gish, San Francisco, CA (US)

(73) Assignee: PDL BioPharma, Inc., Fremont, CA (US)

( * ) Notice: Subject to any disclaimer, the term of this patent is extended or adjusted under 35 U.S.C. 154(b) by 756 days.

(21) Appl. No.: 10/173,999

(22) Filed: Jun. 17, 2002

(65) Prior Publication Data

US 2004/0005563 A1  Jan. 8, 2004

Related U.S. Application Data

(60) Provisional application No. 60/372,246, filed on Apr. 12, 2002, provisional application No. 60/350,666, filed on Nov. 13, 2001, provisional application No. 60/315,287, filed on Aug. 27, 2001, provisional application No. 60/299,234, filed on Jun. 18, 2001.

(51) Int. Cl.
   *C12Q 1/68* (2006.01)
(52) U.S. Cl. .................. 435/6; 536/23.1; 536/23.5; 435/69.1; 435/325; 435/91.2; 435/320.1
(58) Field of Classification Search ............... 536/23.1, 536/23.5; 435/6, 69.1, 325, 320.1, 91.2
   See application file for complete search history.

(56) References Cited

OTHER PUBLICATIONS

Kennell, Progr. Nucl. Acid Res. Mol. Biol. 11: 259 (1971).*
Osterhoff et al, DNA and Cell Biol. 16: 379 (1997).*

* cited by examiner

*Primary Examiner*—James Martinell
(74) *Attorney, Agent, or Firm*—Adam K. Whiting; Howrey LLP

(57) ABSTRACT

Described herein are genes whose expression are up-regulated or down-regulated in ovarian cancer. Related methods and compositions that can be used for diagnosis and treatment of ovarian cancer are disclosed. Also described herein are methods that can be used to identify modulators of ovarian cancer.

13 Claims, No Drawings

METHODS OF DIAGNOSIS OF OVARIAN CANCER, COMPOSITIONS AND METHODS OF SCREENING FOR MODULATORS OF OVARIAN CANCER

CROSS-REFERENCES TO RELATED APPLICATIONS

This application is related to U.S. Ser. No. 60/299,234, filed Jun. 18, 2001; U.S. Ser. No. 60/315,287, filed Aug. 27, 2001; U.S. Ser. No. 60/350,666, filed Nov. 13, 2001; and U.S. Ser. No. 60/372,246, filed Apr. 12, 2002, each of which is incorporated herein by reference for all purposes.

FIELD OF THE INVENTION

The invention relates to the identification of nucleic acid and protein expression profiles and nucleic acids, products, and antibodies thereto that are involved in ovarian cancer; and to the use of such expression profiles and compositions in the diagnosis, prognosis, and therapy of ovarian cancer. The invention further relates to methods for identifying and using agents and/or targets that inhibit ovarian cancer.

BACKGROUND OF THE INVENTION

Ovarian cancer is the sixth most common cancer in women, accounting for 6% of all female cancers. It ranks fifth as the cause of cancer death in women. The American Cancer Society predicts that there will be about 23,100 new cases of ovarian cancer in this country in the year 2000 and about 14,000 women will die of the disease. Because many ovarian cancers cannot be detected early in their development, they account for a disproportionate number of fatal cancers, being responsible for almost half the deaths from cancer of the female genital tract; more deaths than any other reproductive organ cancer.

Most patients with epithelial ovarian cancer, the predominant form, are asymptomatic in early-stage disease and usually present with stage III or IV disease. Their five-year survival is less than 25%, with lower survival among African-American women. The minority of patients discovered with early-stage disease have a five-year survival rate of 80%–90%. See, Parker, et. al. (1997) "Cancer Statistics, 1997" *CA Cancer J. Clin.* 47:5–27.

In the absence of a family history of ovarian cancer, lifetime risk of ovarian cancer is 1/70. Risk factors include familial cancer syndromes (risk of up to 82% by age 70 in women with hereditary breast/ovarian syndrome); family history (1.4% lifetime risk with no affected relatives, 5% with one affected relative, 7% with two affected relatives; Kerlikowske, et. al. (1992) *Obstet. Gynecol.* 80:700–707); nulliparity; advancing age; obesity; personal history of breast, endometrial, or colorectal cancer; fewer pregnancies; or older age (>35 years) at first pregnancy. However, 95% of all ovarian cancers occur in women without risk factors. Use of hormonal contraceptives, oophorectomy, and tubal sterilization reduce risk of ovarian cancer (Kerlikowske, et. al. (1992) *Obstet. Gynecol.* 80:700–707; Grimes (1992) *Am J. Obstet. Gynecol.* 166:1950–1954; Hankinson, et. al. (1993) *JAMA* 270:2813–2818); however, even bilateral oophorectomy may not be completely effective in preventing ovarian cancer.

Treatment of ovarian cancer consists largely of surgical oophorectomy, anti-hormone therapy, and/or chemotherapy. Although many ovarian cancer patients are effectively treated, the current therapies can all induce serious side effects which diminish quality of life. Deciding on a particular course of treatment is typically based on a variety of prognostic parameters and markers (Fitzgibbons, et al. (2000) *Arch. Pathol. Lab. Med.* 124:966–978; Hamilton and Piccart (2000) *Ann. Oncol.* 11:647–663), including genetic predisposition markers BRCA-1 and BRCA-2 (Robson (2000) *J. Clin. Oncol.* 18:113sup–118sup).

The identification of novel therapeutic targets and diagnostic markers is essential for improving the current treatment of ovarian cancer patients. Recent advances in molecular medicine have increased the interest in tumor-specific cell surface antigens that could serve as targets for various immunotherapeutic or small molecule strategies. Antigens suitable for immunotherapeutic strategies should be highly expressed in cancer tissues and ideally not expressed in normal adult tissues. Expression in tissues that are dispensable for life, however, may be tolerated. Examples of such antigens include Her2/neu and the B-cell antigen CD20. Humanized monoclonal antibodies directed to Her2/neu (Herceptin®/trastuzumab) are currently in use for the treatment of metastatic breast cancer. Ross and Fletcher (1998) *Stem Cells* 16:413–428. Similarly, anti-CD20 monoclonal antibodies (Rituxin®/rituximab) are used to effectively treat non-Hodgkin's lymphoma. Maloney, et al. (1997) *Blood* 90:2188–2195; Leget and Czuczman (1998) *Curr. Opin. Oncol.* 10:548–551.

Potential immunotherapeutic targets have been identified for ovarian cancer. One such target is polymorphic epithelial mucin (MUC1). MUC1 is a transmembrane protein, present at the apical surface of glandular epithelial cells. It is often overexpressed in ovarian cancer, and typically exhibits an altered glycosylation pattern, resulting in an antigenically distinct molecule, and is in early clinical trials as a vaccine target. Gilewski, et al. (2000) *Clin. Cancer Res.* 6:1693–1701; Scholl, et al. (2000) *J. Immunother.* 23:570–580. The tumor-expressed protein is often cleaved into the circulation, where it is detectable as the tumor marker, CA 15-3. See, e.g., Bon, et al. (1997) *Clin. Chem.* 43:585–593. However, many patients have tumors that express neither HER2 nor MUC-1; therefore, it is clear that other targets need to be identified to manage localized and metastatic disease.

Mutations in both BRCA1 and BRCA2 are associated with increased susceptibility to ovarian cancer. Mutations in BRCA1 occur in approximately 5 percent (95 percent confidence interval, 3 to 8 percent) of women in whom ovarian cancer is diagnosed before the age of 70 years. See Stratton, et al. (1997) *N.E.J. Med.* 336:1125–1130. And, in BRCA1 gene carriers, the risk for developing ovarian cancer is 0.63. See Easton (1995) *Am. J. Hum. Genet.* 56:267-xxx; and Elit (2001) *Can. Fam. Physician* 47:778–84.

Other biochemical markers such as CA125 have been reported to be associated with ovarian cancer, but they are not absolute indicators of disease. Although roughly 85% of women with clinically apparent ovarian cancer have increased levels of CA125, CA125 is also increased during the first trimester of pregnancy, during menstruation, in the presence of non-cancerous illnesses, and in cancers of other sites.

While industry and academia have identified novel gene sequences, there has not been an equal effort exerted to identify the function of these novel sequences. The elucidation of a role for novel proteins and compounds in disease states for identification of therapeutic targets and diagnostic markers is essential for improving the current treatment of ovarian cancer patients. Accordingly, provided herein are molecular targets for therapeutic intervention in ovarian and other cancers. Additionally, provided herein are methods that can be used in diagnosis and prognosis of ovarian cancer. Further provided are methods that can be used to screen candidate bioactive agents for the ability to modulate ovarian cancer.

SUMMARY OF THE INVENTION

The present invention therefore provides nucleotide sequences of genes that are up- and down-regulated in ovarian cancer cells. Such genes are useful for diagnostic purposes, and also as targets for screening for therapeutic compounds that modulate ovarian cancer, such as hormones or antibodies. The methods of detecting nucleic acids of the invention or their encoded proteins can be used for many purposes, e.g., early detection of ovarian cancers, monitoring and early detection of relapse following treatment, monitoring response to therapy, selecting patients for postoperative chemotherapy or radiation therapy, selecting therapy, determining tumor prognosis, treatment, or response to treatment (of primary or metastatic tumors), and early detection of pre-cancerous lesions. Other aspects of the invention will become apparent to the skilled artisan by the following description of the invention.

In one aspect, the present invention provides a method of detecting an ovarian cancer-associated transcript in a cell from a patient, the method comprising contacting a biological sample from the patient with a polynucleotide that selectively hybridizes to a sequence at least 80% identical to a sequence as shown in Tables 1–20.

In one embodiment, the present invention provides a method of determining the level of an ovarian cancer associated transcript in a cell from a patient.

In one embodiment, the present invention provides a method of detecting an ovarian cancer-associated transcript in a cell from a patient, the method comprising contacting a biological sample from the patient with a polynucleotide that selectively hybridizes to a sequence at least 80% identical to a sequence as shown in Tables 1–20.

In one embodiment, the polynucleotide selectively hybridizes to a sequence at least 95% identical to a sequence as shown in Tables 1–20.

In one embodiment, the biological sample is a tissue sample. In another embodiment, the biological sample comprises isolated nucleic acids, e.g., mRNA.

In one embodiment, the polynucleotide is labeled, e.g., with a fluorescent label.

In one embodiment, the polynucleotide is immobilized on a solid surface.

In one embodiment, the patient is undergoing a therapeutic regimen to treat ovarian cancer. In another embodiment, the patient is suspected of having metastatic ovarian cancer.

In one embodiment, the patient is a human.

In one embodiment, the ovarian cancer associated transcript is mRNA.

In one embodiment, the method further comprises the step of amplifying nucleic acids before the step of contacting the biological sample with the polynucleotide.

In another aspect, the present invention provides a method of monitoring the efficacy of a therapeutic treatment of ovarian cancer, the method comprising the steps of: (i) providing a biological sample from a patient undergoing the therapeutic treatment; and (ii) determining the level of an ovarian cancer-associated transcript in the biological sample by contacting the biological sample with a polynucleotide that selectively hybridizes to a sequence at least 80% identical to a sequence as shown in Tables 1–20, thereby monitoring the efficacy of the therapy. In a further embodiment, the patient has metastatic ovarian cancer. In a further embodiment, the patient has a drug resistant form of ovarian cancer.

In one embodiment, the method further comprises the step of: (iii) comparing the level of the ovarian cancer-associated transcript to a level of the ovarian cancer-associated transcript in a biological sample from the patient prior to, or earlier in, the therapeutic treatment.

Additionally, provided herein is a method of evaluating the effect of a candidate ovarian cancer drug comprising administering the drug to a patient and removing a cell sample from the patient. The expression profile of the cell is then determined. This method may further comprise comparing the expression profile to an expression profile of a healthy individual. In a preferred embodiment, said expression profile includes a gene of Tables 1–20.

In one aspect, the present invention provides an isolated nucleic acid molecule consisting of a polynucleotide sequence as shown in Tables 1–20.

In one embodiment, an expression vector or cell comprises the isolated nucleic acid.

In one aspect, the present invention provides an isolated polypeptide which is encoded by a nucleic acid molecule having polynucleotide sequence as shown in Tables 1–20.

In another aspect, the present invention provides an antibody that specifically binds to an isolated polypeptide which is encoded by a nucleic acid molecule having polynucleotide sequence as shown in Tables 1–20.

In one embodiment, the antibody is conjugated to an effector component, e.g., a fluorescent label, a radioisotope or a cytotoxic chemical.

In one embodiment, the antibody is an antibody fragment. In another embodiment, the antibody is humanized.

In one aspect, the present invention provides a method of detecting an ovarian cancer cell in a biological sample from a patient, the method comprising contacting the biological sample with an antibody as described herein.

In another aspect, the present invention provides a method of detecting antibodies specific to ovarian cancer in a patient, the method comprising contacting a biological sample from the patient with a polypeptide encoded by a nucleic acid comprising a sequence from Tables 1–20.

In another aspect, the present invention provides a method for identifying a compound that modulates an ovarian cancer-associated polypeptide, the method comprising the steps of: (i) contacting the compound with an ovarian cancer-associated polypeptide, the polypeptide encoded by a polynucleotide that selectively hybridizes to a sequence at least 80% identical to a sequence as shown in Tables 1–20; and (ii) determining the functional effect of the compound upon the polypeptide.

In one embodiment, the functional effect is a physical effect, an enzymatic effect, or a chemical effect.

In one embodiment, the polypeptide is expressed in a eukaryotic host cell or cell membrane. In another embodiment, the polypeptide is recombinant.

In one embodiment, the functional effect is determined by measuring ligand binding to the polypeptide.

In another aspect, the present invention provides a method of inhibiting proliferation of an ovarian cancer-associated cell to treat ovarian cancer in a patient, the method comprising the step of administering to the subject a therapeutically effective amount of a compound identified as described herein.

In one embodiment, the compound is an antibody. In another aspect, the present invention provides a drug screening assay comprising the steps of: (i) administering a test compound to a mammal having ovarian cancer or to a cell sample isolated from; (ii) comparing the level of gene expression of a polynucleotide that selectively hybridizes to a sequence at least 80% identical to a sequence as shown in Tables 1–20 in a treated cell or mammal with the level of gene expression of the polynucleotide in a control cell sample or mammal, wherein a test compound that modulates the level of expression of the polynucleotide is a candidate for the treatment of ovarian cancer.

In one embodiment, the control is a mammal with ovarian cancer or a cell sample that has not been treated with the test compound. In another embodiment, the control is a normal cell or mammal, or is non-malignant tissue.

In one embodiment, the test compound is administered in varying amounts or concentrations. In another embodiment, the test compound is administered for varying time periods. In another embodiment, the comparison can occur after addition or removal of the drug candidate.

In one embodiment, the levels of a plurality of polynucleotides that selectively hybridize to a sequence at least 80% identical to a sequence as shown in Tables 1–20 are individually compared to their respective levels in a control cell sample or mammal. In a preferred embodiment the plurality of polynucleotides is from three to ten.

In another aspect, the present invention provides a method for treating a mammal having ovarian cancer comprising administering a compound identified by the assay described herein. In another aspect, the present invention provides a pharmaceutical composition for treating a mammal having ovarian cancer, the composition comprising a compound identified by the assay described herein and a physiologically acceptable excipient.

In one aspect, the present invention provides a method of screening drug candidates by providing a cell expressing a gene that is up- and down-regulated as in an ovarian cancer. In one embodiment, a gene is selected from Tables 1–20. The method further includes adding a drug candidate to the cell and determining the effect of the drug candidate on the expression of the expression profile gene.

In one embodiment, the method of screening drug candidates includes comparing the level of expression in the absence of the drug candidate to the level of expression in the presence of the drug candidate, wherein the concentration of the drug candidate can vary when present, and wherein the comparison can occur after addition or removal of the drug candidate. In a preferred embodiment, the cell expresses at least two expression profile genes. The profile genes may show an increase or decrease.

Also provided is a method of evaluating the effect of a candidate ovarian cancer drug comprising administering the drug to a transgenic animal expressing or over-expressing the ovarian cancer modulatory protein, or an animal lacking the ovarian cancer modulatory protein, for example as a result of a gene knockout.

Moreover, provided herein is a biochip comprising one or more nucleic acid segments of Tables 1–20, wherein the biochip comprises fewer than 1000 nucleic acid probes. Preferably, at least two nucleic acid segments are included. More preferably, at least three nucleic acid segments are included.

Furthermore, a method of diagnosing a disorder associated with ovarian cancer is provided. The method comprises determining the expression of a gene of Tables 1–20 in a first tissue type of a first individual, and comparing the distribution to the expression of the gene from a second normal tissue type from the first individual or a second unaffected individual. A difference in the expression indicates that the first individual has a disorder associated with ovarian cancer.

In a further embodiment, the biochip also includes a polynucleotide sequence of a gene that is not up- and down-regulated in ovarian cancer.

In one embodiment a method for screening for a bioactive agent capable of interfering with the binding of an ovarian cancer modulating protein (ovarian cancer modulatory protein) or a fragment thereof and an antibody which binds to said ovarian cancer modulatory protein or fragment thereof. In a preferred embodiment, the method comprises combining an ovarian cancer modulatory protein or fragment thereof, a candidate bioactive agent and an antibody which binds to said ovarian cancer modulatory protein or fragment thereof. The method further includes determining the binding of said ovarian cancer modulatory protein or fragment thereof and said antibody. Wherein there is a change in binding, an agent is identified as an interfering agent. The interfering agent can be an agonist or an antagonist. Preferably, the agent inhibits ovarian cancer.

Also provided herein are methods of eliciting an immune response in an individual. In one embodiment a method provided herein comprises administering to an individual a composition comprising an ovarian cancer modulating protein, or a fragment thereof. In another embodiment, the protein is encoded by a nucleic acid selected from those of Tables 1–20.

Further provided herein are compositions capable of eliciting an immune response in an individual. In one embodiment, a composition provided herein comprises an ovarian cancer modulating protein, preferably encoded by a nucleic acid of Table 1–20 or a fragment thereof, and a pharmaceutically acceptable carrier. In another embodiment, said composition comprises a nucleic acid comprising a sequence encoding an ovarian cancer modulating protein, preferably selected from the nucleic acids of Tables 1–20, and a pharmaceutically acceptable carrier.

Also provided are methods of neutralizing the effect of an ovarian cancer protein, or a fragment thereof, comprising contacting an agent specific for said protein with said protein in an amount sufficient to effect neutralization. In another embodiment, the protein is encoded by a nucleic acid selected from those of Tables 1–20.

In another aspect of the invention, a method of treating an individual for ovarian cancer is provided. In one embodiment, the method comprises administering to said individual an inhibitor of an ovarian cancer modulating protein. In another embodiment, the method comprises administering to a patient having ovarian cancer an antibody to an ovarian cancer modulating protein conjugated to a therapeutic moiety. Such a therapeutic moiety can be a cytotoxic agent or a radioisotope.

DETAILED DESCRIPTION OF THE INVENTION

In accordance with the objects outlined above, the present invention provides novel methods for diagnosis and prognosis evaluation for ovarian cancer (OC), including metastatic ovarian cancer, as well as methods for screening for compositions which modulate ovarian cancer. Also provided are methods for treating ovarian cancer and related conditions, e.g., ovarian carcinoma (e.g., epithelial (including malignant serous tumors, malignant mucinous tumors, and malignant endometrioid tumors), germ cell (including teratomas, choriocarcinomas, polyembryomas, embryonal carcinoma, endodermal sinus tumor, dysgerminoma, and gonadoblastoma), and stromal carcinomas (e.g., granulosal stromal cell tumors)), fallopian tube carcinoma, and peritoneal carcinoma.

Tables 1–20 provide unigene cluster identification numbers for the nucleotide sequence of genes that exhibit increased or decreased expression in ovarian cancer samples. Tables 1–20 also provide an exemplar accession number that provides a nucleotide sequence that is part of the unigene cluster.

Definitions

The term "ovarian cancer protein" or "ovarian cancer polynucleotide" or "ovarian cancer-associated transcript" refers to nucleic acid and polypeptide polymorphic variants, alleles, mutants, and interspecies homologues that: (1) have a nucleotide sequence that has greater than about 60% nucleotide sequence identity, 65%, 70%, 75%, 80%, 85%, 90%, preferably 91%, 92%, 93%, 94%, 95%, 96%, 97%, 98%, or 99% or greater nucleotide sequence identity, preferably over a region of over a region of at least about 25, 50, 100, 200, 500, 1000, or more nucleotides, to a nucleotide sequence of or associated with a gene of Tables 1–20; (2) bind to antibodies, e.g., polyclonal antibodies, raised against an immunogen comprising an amino acid sequence encoded by a nucleotide sequence of or associated with a gene of Tables 1–20, and conservatively modified variants thereof; (3) specifically hybridize under stringent hybridization conditions to a nucleic acid sequence, or the complement thereof of Tables 1–20 and conservatively modified variants thereof; or (4) have an amino acid sequence that has greater than about 60% amino acid sequence identity, 65%, 70%, 75%, 80%, 85%, 90%, preferably 91%, 92%, 93%, 94%, 95%, 96%, 97%, 98%, or 99% or greater amino sequence identity, preferably over a region of over a region of at least about 25, 50, 100, 200, 500, 1000, or more amino acid, to an amino acid sequence encoded by a nucleotide sequence of or associated with a gene of Tables 1–20. A polynucleotide or polypeptide sequence is typically from a mammal including, but not limited to, primate, e.g., human; rodent, e.g., rat, mouse, hamster; cow, pig, horse, sheep, or other mammal. An "ovarian cancer polypeptide" and an "ovarian cancer polynucleotide," include both naturally occurring or recombinant forms.

A "full length" ovarian cancer protein or nucleic acid refers to an ovarian cancer polypeptide or polynucleotide sequence, or a variant thereof, that contains all of the elements normally contained in one or more naturally occurring, wild type ovarian cancer polynucleotide or polypeptide sequences. The "full length" may be prior to, or after, various stages of post-translation processing or splicing, including alternative splicing.

"Biological sample" as used herein is a sample of biological tissue or fluid that contains nucleic acids or polypeptides, e.g., of an ovarian cancer protein, polynucleotide or transcript. Such samples include, but are not limited to, tissue isolated from primates, e.g., humans, or rodents, e.g., mice, and rats. Biological samples may also include sections of tissues such as biopsy and autopsy samples, frozen sections taken for histologic purposes, blood, plasma, serum, sputum, stool, tears, mucus, hair, skin, etc. Biological samples also include explants and primary and/or transformed cell cultures derived from patient tissues. A biological sample is typically obtained from a eukaryotic organism, most preferably a mammal such as a primate e.g., chimpanzee or human; cow; dog; cat; a rodent, e.g., guinea pig, rat, mouse; rabbit; or a bird; reptile; or fish. Livestock and domestic animals are of particular interest.

"Providing a biological sample" means to obtain a biological sample for use in methods described in this invention. Most often, this will be done by removing a sample of cells from an animal, but can also be accomplished by using previously isolated cells (e.g., isolated by another person, at another time, and/or for another purpose), or by performing the methods of the invention in vivo. Archival tissues, having treatment or outcome history, will be particularly useful.

The terms "identical" or percent "identity," in the context of two or more nucleic acids or polypeptide sequences, refer to two or more sequences or subsequences that are the same or have a specified percentage of amino acid residues or nucleotides that are the same (e.g., about 60% identity, preferably 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site www.ncbi.nlm.nih.gov/BLAST/ or the like). Such sequences are then said to be "substantially identical." This definition also refers to, or may be applied to, the compliment of a test sequence. The definition also includes sequences that have deletions and/or additions, as well as those that have substitutions, as well as naturally occurring, e.g., polymorphic or allelic variants, and man-made variants. As described below, the preferred algorithms can account for gaps and the like. Preferably, identity exists over a region that is at least about 25 amino acids or nucleotides in length, or more preferably over a region that is 50–100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Preferably, default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of one of the number of contiguous positions selected from the group consisting typically of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith and Waterman (1981) *Adv. Appl. Math.* 2:482–489, by the homology alignment algorithm of Needleman and Wunsch (1970) *J. Mol. Biol.* 48:443–453, by the search for similarity method of Pearson and Lipman (1988) *Proc. Nat'l. Acad. Sci. USA* 85:2444–2448, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel, et al. (eds. 1995 and supplements) *Current Protocols in Molecular Biology* Lippincott.

Preferred examples of algorithms that are suitable for determining percent sequence identity and sequence similarity include the BLAST and BLAST 2.0 algorithms, which are described in Altschul, et al. (1977) *Nuc. Acids Res.* 25:3389–3402 and Altschul, et al. (1990) *J. Mol. Biol.* 215:403–410. BLAST and BLAST 2.0 are used, with the parameters described herein, to determine percent sequence identity for the nucleic acids and proteins of the invention. Software for performing BLAST analyses is publicly available through the National Center for Biotechnology Information (www.ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul, et al., supra). These initial neighborhood word hits act as seeds for initiating searches to find longer HSPs containing them. The word hits are extended in both directions along each sequence for as far as the cumulative alignment score can be increased. Cumulative scores are calculated using, e.g., for nucleotide sequences, the parameters M (reward score for a pair of matching residues; always>0) and N (penalty score for mismatching residues; always<0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a word length of 3, and expectation (E) of 10, and the BLOSUM62 scoring matrix (see Henikoff and Henikoff (1989) *Proc. Nat'l Acad. Sci. USA* 89:10915–919) alignments (B) of 50, expectation (E) of 10, M=5, N=−4, and a comparison of both strands.

The BLAST algorithm also performs a statistical analysis of the similarity between two sequences (see, e.g., Karlin and Altschul (1993) *Proc. Nat'l Acad. Sci. USA* 90:5873–5887). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001. Log values may be large negative numbers, e.g., 5, 10, 20, 30, 40, 40, 70, 90, 110, 150, 170, etc.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, e.g., where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequences.

A "host cell" is a naturally occurring cell or a transformed cell that contains an expression vector and supports the replication or expression of the expression vector. Host cells may be cultured cells, explants, cells in vivo, and the like. Host cells may be prokaryotic cells such as *E. coli*, or eukaryotic cells such as yeast, insect, amphibian, or mammalian cells, such as CHO, HeLa, and the like (see, e.g., the American Type Culture Collection catalog or web site, www.atcc.org).

The terms "isolated," "purified," or "biologically pure" refer to material that is substantially or essentially free from components that normally accompany it as found in its native state. Purity and homogeneity are typically determined using analytical chemistry techniques such as polyacrylamide gel electrophoresis or high performance liquid chromatography. A protein or nucleic acid that is the predominant species present in a preparation is substantially purified. In particular, an isolated nucleic acid is separated from some open reading frames that naturally flank the gene and encode proteins other than protein encoded by the gene. The term "purified" in some embodiments denotes that a nucleic acid or protein gives rise to essentially one band in an electrophoretic gel. Preferably, it means that the nucleic acid or protein is at least 85% pure, more preferably at least 95% pure, and most preferably at least 99% pure. "Purify" or "purification" in other embodiments means removing at least one contaminant from the composition to be purified. In this sense, purification does not require that the purified compound be homogenous, e.g., 100% pure.

The terms "polypeptide," "peptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers, those containing modified residues, and non-naturally occurring amino acid polymers.

The term "amino acid" refers to naturally occurring and synthetic amino acids, as well as amino acid analogs and amino acid mimetics that function similarly to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, e.g., an a carbon that is bound to a hydrogen, a carboxyl group, an amino group, and an R group, e.g., homoserine, norleucine, methionine sulfoxide, methionine methyl sulfonium. Such analogs may have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions similarly to a naturally occurring amino acid.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical or associated, e.g., naturally contiguous, sequences. Because of the degeneracy of the genetic code, a large number of functionally identical nucleic acids encode most proteins. For instance, the codons GCA, GCC, GCG, and GCU all encode the amino acid alanine. Thus, at every position where an alanine is specified by a codon, the codon can be altered to another of the corresponding codons described without altering the encoded polypeptide. Such nucleic acid variations are "silent variations," which are one species of conservatively modified variations. Every nucleic acid sequence herein which encodes a polypeptide also describes silent variations of the nucleic acid. In certain contexts each codon in a nucleic acid (except AUG, which is ordinarily the only codon for methionine, and TGG, which is ordinarily the only codon for tryptophan) can be modified to yield a functionally identical molecule. Accordingly, a silent variation of a nucleic acid which encodes a polypeptide is implicit in a described sequence with respect to the expression product, but not necessarily with respect to actual probe sequences.

As to amino acid sequences, one of skill will recognize that individual substitutions, deletions, or additions to a nucleic acid, peptide, polypeptide, or protein sequence which alters, adds, or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention. Typically conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton (1984) Proteins Freeman).

Macromolecular structures such as polypeptide structures can be described in terms of various levels of organization. For a general discussion of this organization, see, e.g., Alberts, et al. (2001) *Molecular Biology of the Cell* (4th ed.) Garland Pub.; and Cantor and Schimmel (1980) *Biophysical Chemistry Part I: The Conformation of Biological Macromolecules* Freeman. "Primary structure" refers to the amino acid sequence of a particular peptide. "Secondary structure" refers to locally ordered, three dimensional structures within a polypeptide. These structures are commonly known as domains. Domains are portions of a polypeptide that often form a compact unit of the polypeptide and are typically 25 to approximately 500 amino acids long. Typical domains are made up of sections of lesser organization such as stretches of β-sheet and α-helices. "Tertiary structure" refers to the complete three dimensional structure of a polypeptide monomer. "Quaternary structure" refers to the three dimensional structure formed, usually by the non-covalent association of independent tertiary units. Anisotropic terms are also known as energy terms.

"Nucleic acid" or "oligonucleotide" or "polynucleotide" or grammatical equivalents used herein means at least two nucleotides covalently linked together. Oligonucleotides are typically from about 5, 6, 7, 8, 9, 10, 12, 15, 25, 30, 40, 50, or more nucleotides in length, up to about 100 nucleotides in length. Nucleic acids and polynucleotides are a polymers of any length, including longer lengths, e.g., 200, 300, 500, 1000, 2000, 3000, 5000, 7000, 10,000, etc. A nucleic acid of the present invention will generally contain phosphodiester bonds, although in some cases, nucleic acid analogs are included that may have at least one different linkage, e.g., phosphoramidate, phosphorothioate, phosphorodithioate, or O-methylphosphoroamidite linkages (see Eckstein (1992) *Oligonucleotides and Analogues: A Practical Approach* Oxford University Press); and peptide nucleic acid backbones and linkages. Other analog nucleic acids include those with positive backbones; non-ionic backbones, and non-ribose backbones, including those described in U.S. Pat. Nos. 5,235,033 and 5,034,506, and Chapters 6 and 7 of Sanghvi and Cook (eds. 1994) *Carbohydrate Modifications in Antisense Research* ASC Symposium Series 580. Nucleic acids containing one or more carbocyclic sugars are also included within one definition of nucleic acids. Modifications of the ribose-phosphate backbone may be done for a variety of reasons, e.g., to increase the stability and half-life of such molecules in physiological environments or as probes on a biochip. Mixtures of naturally occurring nucleic acids and analogs can be made; alternatively, mixtures of different nucleic acid analogs, and mixtures of naturally occurring nucleic acids and analogs may be made.

A variety of references disclose such nucleic acid analogs, including, e.g., phosphoramidate (Beaucage, et al. (1993) *Tetrahedron* 49:1925–1963 and references therein; Letsinger (1970) *J. Org. Chem.* 35:3800–3803; Sprinzl, et al. (1977) *Eur. J. Biochem.* 81:579–589; Letsinger, et al. (1986) *Nucl. Acids Res.* 14:3487–499; Sawai, et al. (1984) *Chem. Lett.* 805, Letsinger, et al. (1988) *J. Am. Chem. Soc.* 110:4470–4471; and Pauwels, et al. (1986), *Chemica Scripta* 26:141–149), phosphorothioate (Mag, et al. (1991) *Nucl. Acids Res.* 19:1437–441; and U.S. Pat. No. 5,644,048), phosphorodithioate (Brill, et al. (1989) *J. Am. Chem. Soc.* 111:2321–2322), O-methylphophoroamidite linkages (see Eckstein (1992) *Oligonucleotides and Analogues: A Practical Approach* Oxford Univ. Press), and peptide nucleic acid backbones and linkages (see Egholm (1992) *J. Am. Chem. Soc.* 114:1895–897; Meier, et al. (1992) *Angew. Chem. Int. Ed. Engl.* 31:1008–1010; Nielsen (1993) *Nature,* 365:566–568; Carlsson, et al. (1996) *Nature* 380:207, each of which is incorporated by reference). Other analog nucleic acids include those with positive backbones (Denpcy, et al. (1995) *Proc. Nat'l Acad. Sci. USA* 92:6097–101; non-ionic backbones (U.S. Pat. Nos. 5,386,023, 5,637,684, 5,602,240, 5,216,141 and 4,469,863; Kiedrowshi, et al. (1991) *Angew. Chem. Intl. Ed. English* 30:423–426; Letsinger, et al. (1988) *J. Am. Chem. Soc.* 110:4470–4471; Jung, et al. (1994) *Nucleoside and Nucleotide* 13:1597; Chapters 2 and 3, in Sanghvi and Cook (eds. 1994) *Carbohydrate Modifications in Antisense Research* ASC Symposium Series 580; Mesmaeker, et al. (1994) *Bioorganic and Medicinal Chem. Lett.* 4:395–398; Jeffs, et al. (1994) *J. Biomolecular NMR* 34:17-xx; Horn, et al. (1996) *Tetrahedron Lett.* 37:743-xxx) and non-ribose backbones, including those described in U.S. Pat. Nos. 5,235,033 and 5,034,506, and Chapters 6 and 7, in Sanghvi and Cook (eds. 1994) *Carbohydrate Modifications in Antisense Research* ASC Symposium Series 580. Nucleic acids containing one or more carbocyclic sugars are also included within one definition of nucleic acids (see Jenkins, et al. (1995) *Chem. Soc. Rev.* pp 169–176). Several nucleic acid analogs are described in Rawls (p. 35 Jun. 2, 1997) *C&E News.* Each of these references is hereby expressly incorporated by reference.

Particularly preferred are peptide nucleic acids (PNA) which includes peptide nucleic acid analogs. These backbones are substantially non-ionic under neutral conditions, in contrast to the highly charged phosphodiester backbone of naturally occurring nucleic acids. This results in two advantages. First, the PNA backbone exhibits improved hybridization kinetics. PNAs have larger changes in the melting temperature ($T_m$) for mismatched versus perfectly matched base pairs. DNA and RNA typically exhibit a 2–4° C. drop in $T_m$ for an internal mismatch. With the non-ionic PNA backbone, the drop is closer to 7–9° C. Similarly, due to their non-ionic nature, hybridization of the bases attached to these backbones is relatively insensitive to salt concentration. In addition, PNAs are not degraded by cellular enzymes, and thus can be more stable.

The nucleic acids may be single stranded or double stranded, as specified, or contain portions of both double stranded or single stranded sequence. As will be appreciated by those in the art, the depiction of a single strand also defines the sequence of the complementary strand; thus the sequences described herein also provide the complement of the sequence. The nucleic acid may be DNA, both genomic and cDNA, RNA, or a hybrid, where the nucleic acid may contain combinations of deoxyribo- and ribo-nucleotides, and combinations of bases, including uracil, adenine, thymine, cytosine, guanine, inosine, xanthine hypoxanthine, isocytosine, isoguanine, etc. "Transcript" typically refers to a naturally occurring RNA, e.g., a pre-mRNA, hnRNA, or mRNA. As used herein, the term "nucleoside" includes nucleotides and nucleoside and nucleotide analogs, and modified nucleosides such as amino modified nucleosides. In addition, "nucleoside" includes non-naturally occurring analog structures. Thus, e.g., the individual units of a peptide nucleic acid, each containing a base, are referred to herein as a nucleoside.

A "label" or a "detectable moiety" is a composition detectable by spectroscopic, photochemical, biochemical, immunochemical, chemical, or other physical means. For example, useful labels include $^{32}$P, fluorescent dyes, electron-dense reagents, enzymes (e.g., as commonly used in an ELISA), biotin, digoxigenin, or haptens and proteins or other entities which can be made detectable, e.g., by incorporating a radiolabel into the peptide or used to detect antibodies specifically reactive with the peptide. The labels may be incorporated into the ovarian cancer nucleic acids, proteins and antibodies at any position. Any method known in the art for conjugating the antibody to the label may be employed, including those methods described by Hunter, et al. (1962) *Nature* 144:945-xxx; David, et al. (1974) *Biochemistry* 13:1014–1021; Pain, et al. (1981) *J. Immunol. Meth.* 40:219–230; and Nygren (1982) *J. Histochem. and Cytochem.* 30:407–412.

An "effector" or "effector moiety" or "effector component" is a molecule that is bound (or linked, or conjugated), either covalently, through a linker or a chemical bond, or non-covalently, through ionic, van der Waals, electrostatic, or hydrogen bonds, to an antibody. The "effector" can be a variety of molecules including, e.g., detection moieties including radioactive compounds, fluorescent compounds, an enzyme or substrate, tags such as epitope tags, a toxin; activatable moieties, a chemotherapeutic agent; a lipase; an antibiotic; or a radioisotope emitting "hard" e.g., beta radiation.

A "labeled nucleic acid probe or oligonucleotide" is one that is bound, either covalently, through a linker or a chemical bond, or non-covalently, through ionic, van der Waals, electrostatic, or hydrogen bonds to a label such that the presence of the probe may be detected by detecting the presence of the label bound to the probe. Alternatively, method using high affinity interactions may achieve the same results where one of a pair of binding partners binds to the other, e.g., biotin, streptavidin.

As used herein a "nucleic acid probe or oligonucleotide" is a nucleic acid capable of binding to a target nucleic acid of complementary sequence through one or more types of chemical bonds, usually through complementary base pairing, usually through hydrogen bond formation. As used herein, a probe may include natural (e.g., A, G, C, or T) or modified bases (7-deazaguanosine, inosine, etc.). In addition, the bases in a probe may be joined by a linkage other than a phosphodiester bond, so long as it does not functionally interfere with hybridization. Thus, e.g., probes may be peptide nucleic acids in which the constituent bases are joined by peptide bonds rather than phosphodiester linkages. Probes may bind target sequences lacking complete complementarity with the probe sequence depending upon the stringency of the hybridization conditions. The probes are preferably directly labeled, e.g., with isotopes, chromophores, lumiphores, chromogens, or indirectly labeled such as with biotin to which a streptavidin complex may later bind. By assaying for the presence or absence of the probe, one can detect the presence or absence of the select sequence or subsequence. Diagnosis or prognosis may be based at the genomic level, or at the level of RNA or protein expression.

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, e.g., recombinant cells express genes that are not found within the native (non-recombinant) form of the cell or express native genes that are otherwise abnormally expressed, under expressed or not expressed at all. By the term "recombinant nucleic acid" herein is meant nucleic acid, originally formed in vitro, in general, by the manipulation of nucleic acid, e.g., using polymerases and endonucleases, in a form not normally found in nature. In this manner, operably linkage of different sequences is achieved. Thus an isolated nucleic acid, in a linear form, or an expression vector formed in vitro by ligating DNA molecules that are not normally joined, are both considered recombinant for the purposes of this invention. It is understood that once a recombinant nucleic acid is made and reintroduced into a host cell or organism, it will replicate non-recombinantly, e.g., using the in vivo cellular machinery of the host cell rather than in vitro manipulations; however, such nucleic acids, once produced recombinantly, although subsequently replicated non-recombinantly, are still considered recombinant for the purposes of the invention. Similarly, a "recombinant protein" is a protein made using recombinant techniques, e.g., through the expression of a recombinant nucleic acid as depicted above.

The term "heterologous" when used with reference to portions of a nucleic acid indicates that the nucleic acid comprises two or more subsequences that are not normally found in the same relationship to each other in nature. For instance, the nucleic acid is typically recombinantly produced, having two or more sequences, e.g., from unrelated genes arranged to make a new functional nucleic acid, e.g., a promoter from one source and a coding region from another source. Similarly, a heterologous protein will often refer to two or more subsequences that are not found in the same relationship to each other in nature (e.g., a fusion protein).

A "promoter" is defined as an array of nucleic acid control sequences that direct transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription. A "constitutive" promoter is a promoter that is active under most environmental and developmental conditions. An "inducible" promoter is a promoter that is active under environmental or developmental regulation. The term "operably linked" refers to a functional linkage between a nucleic acid expression control sequence (such as a promoter, or array of transcription factor binding sites) and a second nucleic acid sequence, e.g., wherein the expression control sequence directs transcription of the nucleic acid corresponding to the second sequence.

An "expression vector" is a nucleic acid construct, generated recombinantly or synthetically, with a series of specified nucleic acid elements that permit transcription of a particular nucleic acid in a host cell. The expression vector can be part of a plasmid, virus, or nucleic acid fragment. Typically, the expression vector includes a nucleic acid to be transcribed operably linked to a promoter.

The phrase "selectively (or specifically) hybridizes to" refers to the binding, duplexing, or hybridizing of a molecule only to a particular nucleotide sequence under stringent hybridization conditions when that sequence is present in a complex mixture (e.g., total cellular or library DNA or RNA).

The phrase "stringent hybridization conditions" refers to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in "Overview of principles of hybridization and the strategy of nucleic acid assays" in Tijssen (1993) *Hybridization with Nucleic Probes* (*Laboratory Techniques in Biochemistry and Molecular Biology*) (vol. 24) Elsevier. Generally, stringent conditions are selected to be about 5–10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. For selective or specific hybridization, a positive signal is typically at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C. For PCR, a temperature of about 36° C. is typical for low stringency amplification, although annealing temperatures may vary between about 32–48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90–95° C. for 30–120 sec, an annealing phase lasting 30–120 sec, and an extension phase of about 72° C. for 1–2 min. Protocols and guidelines for low and high stringency amplification reactions are available, e.g., in Innis, et al. (1990) *PCR Protocols: A Guide to Methods and Applications* Academic Press, N.Y.

Nucleic acids that do not hybridize to each other under stringent conditions are still substantially identical if the polypeptides which they encode are substantially identical. This occurs, e.g., when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Alternative hybridization and wash conditions can be utilized to provide conditions of similar stringency. Additional guidelines for determining hybridization parameters are provided, e.g., Ausubel, et al. (ed. 1991 and supplements) *Current Protocols in Molecular Biology* Lippincott.

The phrase "functional effects" in the context of assays for testing compounds that modulate activity of an ovarian cancer protein includes the determination of a parameter that is indirectly or directly under the influence of the ovarian cancer protein or nucleic acid, e.g., a functional, physical, physiological, or chemical effect, such as the ability to decrease ovarian cancer. It includes ligand binding activity; cell growth on soft agar; anchorage dependence; contact inhibition and density limitation of growth; cellular proliferation; cellular transformation; growth factor or serum dependence; tumor specific marker levels; invasiveness into Matrigel; tumor growth and metastasis in vivo; mRNA and protein expression in cells undergoing metastasis, and other characteristics of ovarian cancer cells. "Functional effects" include in vitro, in vivo, and ex vivo activities.

By "determining the functional effect" is meant assaying for a compound that increases or decreases a parameter that is indirectly or directly under the influence of an ovarian cancer protein sequence, e.g., functional, enzymatic, physical, physiological, and chemical effects. Such functional effects can be measured by any means known to those skilled in the art, e.g., changes in spectroscopic characteristics (e.g., fluorescence, absorbance, refractive index), hydrodynamic (e.g., shape), chromatographic, or solubility properties for the protein, measuring inducible markers or transcriptional activation of the ovarian cancer protein; measuring binding activity or binding assays, e.g., binding to antibodies or other ligands, and measuring cellular proliferation. Determination of the functional effect of a compound on ovarian cancer can also be performed using ovarian cancer assays known to those of skill in the art such as an in vitro assays, e.g., cell growth on soft agar; anchorage dependence; contact inhibition and density limitation of growth; cellular proliferation; cellular transformation; growth factor or serum dependence; tumor specific marker levels; invasiveness into Matrigel; tumor growth and metastasis in vivo; mRNA and protein expression in cells undergoing metastasis, and other characteristics of ovarian cancer cells. The functional effects can be evaluated by means known to those skilled in the art, e.g., microscopy for quantitative or qualitative measures of alterations in morphological features, measurement of changes in RNA or protein levels for ovarian cancer-associated sequences, measurement of RNA stability, or identification of downstream or reporter gene expression (CAT, luciferase, β-gal, GFP, and the like), e.g., via chemiluminescence, fluorescence, colorimetric reactions, antibody binding, inducible markers, and ligand binding assays.

"Inhibitors", "activators", and "modulators" of ovarian cancer polynucleotide and polypeptide sequences are used to refer to activating, inhibitory, or modulating molecules or compounds identified using in vitro and in vivo assays of ovarian cancer polynucleotide and polypeptide sequences. Inhibitors are compounds that, e.g., bind to, partially or totally block activity, decrease, prevent, delay activation, inactivate, desensitize, or down regulate the activity or expression of ovarian cancer proteins, e.g., antagonists. Antisense or inhibitory nucleic acids may inhibit expression and subsequent function of the protein. "Activators" are compounds that increase, open, activate, facilitate, enhance activation, sensitize, agonize, or up regulate ovarian cancer protein activity. Inhibitors, activators, or modulators also include genetically modified versions of ovarian cancer proteins, e.g., versions with altered activity, as well as naturally occurring and synthetic ligands, antagonists, agonists, antibodies, small chemical molecules, and the like. Assays for inhibitors and activators include, e.g., expressing the ovarian cancer protein in vitro, in cells, or cell membranes, applying putative modulator compounds, and then determining the functional effects on activity, as described above. Activators and inhibitors of ovarian cancer can also be identified by incubating ovarian cancer cells with the test compound and determining increases or decreases in the expression of one or more ovarian cancer proteins, e.g., 1, 2, 3, 4, 5, 10, 15, 20, 25, 30, 40, 50, or more ovarian cancer proteins, such as ovarian cancer proteins encoded by the sequences set out in Tables 1–20.

Samples or assays comprising ovarian cancer proteins that are treated with a potential activator, inhibitor, or modulator are compared to control samples without the inhibitor, activator, or modulator to examine the extent of inhibition. Control samples (untreated with inhibitors) are assigned a relative protein activity value of 100%. Inhibition of a polypeptide is achieved when the activity value relative to the control is about 80%, preferably 50%, more preferably 25% or less. Activation of an ovarian cancer polypeptide is achieved when the activity value relative to the control (untreated with activators) is 110%, more preferably 150%, more preferably 200–500% (e.g., 2–5 fold higher relative to the control), more preferably 1000–3000% higher.

The phrase "changes in cell growth" refers to a change in cell growth and proliferation characteristics in vitro or in vivo, e.g., cell viability, formation of foci, anchorage independence, semi-solid or soft agar growth, change in contact inhibition or density limitation of growth, loss of growth factor or serum requirements, change in cell morphology, gain or loss of immortalization, gain or loss of tumor specific markers, ability to form or suppress tumors when injected into suitable animal hosts, and/or immortalization of the cell. See, e.g., pp. 231–241 in Freshney (1994) *Culture of Animal Cells: A Manual of Basic Technique* (3d ed.) Wiley-Liss.

"Tumor cell" refers to pre-cancerous, cancerous, and normal cells in a tumor.

"Cancer cells," "transformed" cells or "transformation" in tissue culture, refers to spontaneous or induced phenotypic changes that do not necessarily involve the uptake of new genetic material. Although transformation can arise from infection with a transforming virus and incorporation of new genomic DNA, or uptake of exogenous DNA, it can also arise spontaneously or following exposure to a carcinogen, thereby mutating an endogenous gene. Transformation is typically associated with phenotypic changes, such as immortalization of cells, aberrant growth control, non-morphological changes, and/or malignancy. See, Freshney (1994) *Culture of Animal Cells.*

"Antibody" refers to a polypeptide comprising a framework region from an immunoglobulin gene or fragments thereof that specifically binds and recognizes an antigen. The recognized immunoglobulin genes include the kappa, lambda, alpha, gamma, delta, epsilon, and mu constant region genes, as well as the myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD, and IgE, respectively. Typically, the antigen-binding region of an antibody or its functional equivalent will be most critical in specificity and affinity of binding. See, e.g., Paul (ed. 1999) *Fundamental Immunology* (4th ed.) Raven.

An exemplary immunoglobulin (antibody) structural unit comprises a tetramer. Each tetramer is composed of two identical pairs of polypeptide chains, each pair having one "light" (about 25 kD) and one "heavy" chain (about 50–70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively.

Antibodies exist, e.g., as intact immunoglobulins or as a number of well-characterized fragments produced by digestion with various peptidases. Thus, e.g., pepsin digests an antibody below the disulfide linkages in the hinge region to produce F(ab)'$_2$, a dimer of Fab which itself is a light chain joined to $V_H$-$C_H$1 by a disulfide bond. The F(ab)'$_2$ may be reduced under mild conditions to break the disulfide linkage in the hinge region, thereby converting the F(ab)'$_2$ dimer into an Fab' monomer. The Fab'0 monomer is essentially Fab with part of the hinge region. See Paul (ed. 1999) *Fundamental Immunology* (4th ed.) Raven. While various antibody fragments are defined in terms of the digestion of an intact antibody, one of skill will appreciate that such fragments may be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries. See, e.g., McCafferty, et al. (1990) *Nature* 348: 552–554.

For preparation of antibodies, e.g., recombinant, monoclonal, or polyclonal antibodies, many techniques known in the art can be used (see, e.g., Kohler and Milstein (1975) *Nature* 256:495–497; Kozbor, et al. (1983) *Immunology Today* 4:72; Cole, et al., pp. 77–96 in Reisfeld and Sell (1985) *Monoclonal Antibodies and Cancer Therapy* Liss; Coligan (1991) *Current Protocols in Immunology* Lippincott; Harlow and Lane (1988) *Antibodies: A Laboratory Manual* CSH Press; and Goding (1986) *Monoclonal Antibodies: Principles and Practice* (2d ed.) Academic Press. Techniques for the production of single chain antibodies (U.S. Pat. No. 4,946,778) can be adapted to produce antibodies to polypeptides of this invention. Transgenic mice, or other organisms, e.g., other mammals, may be used to express humanized antibodies. Alternatively, phage display technology can be used to identify antibodies and heteromeric Fab fragments that specifically bind to selected antigens. See, e.g., McCafferty, et al. (1990) *Nature* 348:552–554; and Marks, et al. (1992) *Biotechnology* 10:779–783.

A "chimeric antibody" is an antibody molecule in which (a) the constant region, or a portion thereof, is altered, replaced or exchanged so that the antigen binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity.

Identification of Ovarian Cancer-associated Sequences

In one aspect, the expression levels of genes are determined in different patient samples for which diagnosis information is desired, to provide expression profiles. An expression profile of a particular sample is essentially a "fingerprint" of the state of the sample; while two states may have any particular gene similarly expressed, the evaluation of a number of genes simultaneously allows the generation of a gene expression profile that is characteristic of the state of the cell. That is, normal tissue (e.g., normal ovarian or other tissue) may be distinguished from cancerous or metastatic cancerous tissue of the ovarian, or ovarian cancer tissue or metastatic ovarian cancerous tissue can be compared with tissue samples of ovarian and other tissues from surviving cancer patients. By comparing expression profiles of tissue in known different ovarian cancer states, information regarding which genes are important (including both up- and down-regulation of genes) in each of these states is obtained. Molecular profiling may distinguish subtypes of a currently collective disease designation, e.g., different forms of a cancer.

The identification of sequences that are differentially expressed in ovarian cancer versus non-ovarian cancer tissue allows the use of this information in a number of ways. For example, a particular treatment regime may be evaluated: does a chemotherapeutic drug act to down-regulate ovarian cancer, and thus tumor growth or recurrence, in a particular patient. Alternatively, does existing treatment induce expression of a target. Similarly, diagnosis and treatment outcomes may be done or confirmed by comparing patient samples with the known expression profiles. Metastatic tissue can also be analyzed to determine the stage of ovarian cancer in the tissue or origin of the primary tumor. Furthermore, these gene expression profiles (or individual genes) allow screening of drug candidates with an eye to mimicking or altering a particular expression profile; e.g., screening can be done for drugs that suppress the ovarian cancer expression profile. This may be done by making biochips comprising sets of the important ovarian cancer genes, which can then be used in these screens. These methods can also be based on evaluating protein expression; that is, protein expression levels of the ovarian cancer proteins can be evaluated for diagnostic purposes or to screen candidate agents. In addition, the ovarian cancer nucleic acid sequences can be administered for gene therapy purposes, including the administration of antisense or RNAi nucleic acids, or the ovarian cancer proteins (including antibodies and other modulators thereof) administered as therapeutic drugs.

Thus the present invention provides nucleic acid and protein sequences that are differentially expressed in ovarian cancer relative to normal tissues and/or non-malignant tissues, herein termed "ovarian cancer sequences." As outlined below, ovarian cancer sequences include those that are up-regulated (e.g., expressed at a higher level) in ovarian cancer, as well as those that are down-regulated (e.g., expressed at a lower level). In a preferred embodiment, the ovarian cancer sequences are from humans; however, as will be appreciated by those in the art, ovarian cancer sequences from other organisms may be useful in animal models of disease and drug evaluation; thus, other ovarian cancer sequences are provided, from vertebrates, including mammals, including rodents (rats, mice, hamsters, guinea pigs, etc.), primates, farm animals (including sheep, goats, pigs, cows, horses, etc.) and pets (e.g., dogs, cats, etc.). Ovarian cancer sequences, e.g., counterpart genes, from other organisms may be obtained using the techniques outlined below.

Ovarian cancer sequences can include both nucleic acid and amino acid sequences. Ovarian cancer nucleic acid sequences are useful in a variety of applications, including diagnostic applications, which will detect naturally occurring nucleic acids. Screening applications; e.g., biochips comprising nucleic acid probes or PCR microtiter plates with selected probes to the ovarian cancer sequences, are also provided.

An ovarian cancer sequence can be initially identified by substantial nucleic acid and/or amino acid sequence homology to the ovarian cancer sequences outlined herein. Such homology can be based upon the overall nucleic acid or amino acid sequence, and is generally determined as outlined below, using either homology programs or hybridization conditions.

For identifying ovarian cancer-associated sequences, the ovarian cancer screen typically includes comparing genes identified in different tissues, e.g., normal and cancerous tissues, or tumor tissue samples from patients who have metastatic disease vs. non metastatic tissue. Other suitable tissue comparisons include comparing ovarian cancer samples with metastatic cancer samples from other cancers, such as lung, ovarian, gastrointestinal cancers, etc. Samples of different stages of ovarian cancer, e.g., survivor tissue, drug resistant states, and tissue undergoing metastasis, are applied to biochips comprising nucleic acid probes. The samples are first microdissected, if applicable, and treated for the preparation of mRNA. Suitable biochips are commercially available, e.g., from Affymetrix. Gene expression profiles as described herein are generated and the data analyzed.

In one embodiment, the genes showing changes in expression as between normal and disease states are compared to genes expressed in other normal tissues, preferably normal ovarian, but also including, and not limited to, lung, heart, brain, liver, ovarian, kidney, muscle, colon, small intestine, large intestine, spleen, bone, and/or placenta. In a preferred embodiment, those genes identified during the ovarian cancer screen that are expressed in any significant amount in other tissues are removed from the profile, although in some embodiments, expression in non-essential tissues may be tolerated. That is, when screening for drugs, it is usually preferable that the target be disease specific, to minimize possible side effects by interaction with target present in other organs.

In a preferred embodiment, ovarian cancer sequences are those that are up-regulated in ovarian cancer; that is, the expression of these genes is higher in the ovarian cancer tissue as compared to non-cancerous tissue. "Up-regulation" as used herein often means at least about a two-fold change, preferably at least about a three fold change, with at least about five-fold or higher being preferred. Other embodiments are directed to sequences up regulated in non-malignant conditions relative to normal.

Unigene cluster identification numbers and accession numbers herein refer to the GenBank sequence database and the sequences of the accession numbers are hereby expressly incorporated by reference. GenBank is known in the art, see, e.g., Benson, et al. (1998) *Nucl. Acids Res.* 26:1–7; and www.ncbi.nlm.nih.gov. Sequences are also available in other databases, e.g., European Molecular Biology Laboratory (EMBL) and DNA Database of Japan (DDBJ). In some situations, the sequences may be derived from assembly of available sequences or be predicted from genomic DNA using exon prediction algorithms, e.g., FGENESH. See Salamov and Solovyev (2000) *Genome Res.* 10:516–522. In other situations, sequences have been derived from cloning and sequencing of isolated nucleic acids.

In another preferred embodiment, ovarian cancer sequences are those that are down-regulated in ovarian cancer; that is, the expression of these genes is lower in ovarian cancer tissue as compared to non-cancerous tissue. "Down-regulation" as used herein often means at least about a two-fold change, preferably at least about a three-fold change, with at least about five-fold or higher being preferred.

Informatics

The ability to identify genes that are over or under expressed in ovarian cancer can additionally provide high-resolution, high-sensitivity datasets which can be used in the areas of diagnostics, therapeutics, drug development, pharmacogenetics, protein structure, biosensor development, and other related areas. Expression profiles can be used in diagnostic or prognostic evaluation of patients with ovarian cancer. Subcellular toxicological information can be generated to better direct drug structure and activity correlation (see Anderson (Jun. 11–12, 1998) *Pharmaceutical Proteomics: Targets, Mechanism, and Function*, paper presented at the IBC Proteomics conference, Coronado, Calif.) or in a biological sensor device to predict the likely toxicological effect of chemical exposures and likely tolerable exposure thresholds (see U.S. Pat. No. 5,811,231). Similar advantages accrue from datasets relevant to other biomolecules and bioactive agents (e.g., nucleic acids, saccharides, lipids, drugs, and the like).

Thus, in another embodiment, the present invention provides a database that includes at least one set of assay data. The data contained in the database is acquired, e.g., using array analysis either singly or in a library format. The database can be in a form in which data can be maintained and transmitted, but is preferably an electronic database, and can be maintained on any electronic device allowing for the storage of and access to the database, such as a personal computer, but is preferably distributed on a wide area network, such as the World Wide Web.

The focus of the present section on databases that include peptide sequence data is for clarity of illustration only. It will be apparent to those of skill in the art that similar databases can be assembled for any assay data acquired using an assay of the invention.

The compositions and methods for identifying and/or quantitating the relative and/or absolute abundance of a variety of molecular and macromolecular species from a biological sample undergoing ovarian cancer, e.g., the identification of ovarian cancer-associated sequences described herein, provide an abundance of information which can be correlated with pathological conditions, predisposition to disease, drug testing, therapeutic monitoring, gene-disease causal linkages, identification of correlates of immunity and physiological status, and outcome data, among others. Although data generated from the assays of the invention is suited for manual review and analysis, in a preferred embodiment, data processing using high-speed computers is utilized.

An array of methods for indexing and retrieving biomolecular information is known in the art. For example, U.S. Pat. Nos. 6,023,659 and 5,966,712 disclose a relational database system for storing biomolecular sequence information in a manner that allows sequences to be catalogued and searched according to one or more protein function hierarchies. U.S. Pat. No. 5,953,727 discloses a relational database having sequence records containing information in a format that allows a collection of partial-length DNA sequences to be catalogued and searched according to association with one or more sequencing projects for obtaining full-length sequences from the collection of partial length sequences. U.S. Pat. No. 5,706,498 discloses a gene database retrieval system for making a retrieval of a gene sequence similar to a sequence data item in a gene database based on the degree of similarity between a key sequence and a target sequence. U.S. Pat. No. 5,538,897 discloses a method using mass spectroscopy fragmentation patterns of peptides to identify amino acid sequences in computer databases by comparison of predicted mass spectra with experimentally-derived mass spectra using a closeness-of-fit measure. U.S. Pat. No. 5,926,818 discloses a multi-dimensional database comprising a functionality for multi-dimensional data analysis described as on-line analytical processing (OLAP), which entails the consolidation of projected and actual data according to more than one consolidation path or dimension. U.S. Pat. No. 5,295,261 reports a hybrid database structure in which the fields of each database record are divided into two classes, navigational and informational data, with navigational fields stored in a hierarchical topological map which can be viewed as a tree structure or as the merger of two or more such tree structures.

Fundamentals of bioinformatics are provided, e.g., in Mount, et al. (2001) *Bioinformatics: Sequence and Genome Analysis* CSH Press, NY; Durbin, et al. (eds. 1999) *Biological Sequence Analysis: Probabilistic Models of Proteins and Nucleic Acids* Cambridge Univ. Press; Baxevanis and Oeullette (eds. 1998) *Bioinformatics: A Practical Guide to the Analysis of Genes and Proteins* (2d ed.) Wiley-Liss; Rashidi and Buehler (1999) *Bioinformatics: Basic Applications in Biological Science and Medicine* CRC Press; Setubal, et al. (eds 1997) *Introduction to Computational Molecular Biology* Brooks/Cole; Misener and Krawetz (eds. 2000) *Bioinformatics: Methods and Protocols* Humana Press; Higgins and Taylor (eds. 2000) *Bioinformatics: Sequence, Structure, and Databanks: A Practical Approach* Oxford Univ. Press; Brown (2001) *Bioinformatics: A Biologist's Guide to Biocomputing and the Internet* Eaton Pub.; Han and Kamber (2000) *Data Mining: Concepts and Techniques* Kaufmann Pub.; and Waterman (1995) *Introduction to Computational Biology: Maps, Sequences, and Genomes* Chap and Hall.

The present invention provides a computer database comprising a computer and software for storing in computer-retrievable form assay data records cross-tabulated, e.g., with data specifying the source of the target-containing sample from which each sequence specificity record was obtained.

In an exemplary embodiment, at least one of the sources of target-containing sample is from a control tissue sample known to be free of pathological disorders. In a variation, at least one of the sources is a known pathological tissue specimen, e.g., a neoplastic lesion or another tissue specimen to be analyzed for ovarian cancer. In another variation, assay records cross-tabulate one or more of the following parameters for a target species in a sample: (1) a unique identification code, which can include, e.g., a target molecular structure and/or characteristic separation coordinate (e.g., electrophoretic or genomic position coordinates); (2) sample source; and (3) absolute and/or relative quantity of target species present in the sample.

The invention also provides for the storage and retrieval of a collection of target data in a computer data storage apparatus, which can include magnetic disks, optical disks, magneto-optical disks, DRAM, SRAM, SGRAM, SDRAM, RDRAM, DDR RAM, magnetic bubble memory devices, and other data storage devices, including CPU registers and on-CPU data storage arrays. Typically, the target data records are stored as a bit pattern in an array of magnetic domains on a magnetizable medium or as an array of charge states or transistor gate states, such as an array of cells in a DRAM device (e.g., each cell comprised of a transistor and a charge storage area, which may be on the transistor). In one embodiment, the invention provides such storage devices, and computer systems built therewith, comprising a bit pattern encoding a protein expression fingerprint record comprising unique identifiers for at least 10 target data records cross-tabulated with target source.

When the target is a peptide or nucleic acid, the invention preferably provides a method for identifying related peptide or nucleic acid sequences, comprising performing a computerized comparison between a peptide or nucleic acid sequence assay record stored in or retrieved from a computer storage device or database and at least one other sequence. The comparison can include a sequence analysis or comparison algorithm or computer program embodiment thereof (e.g., FASTA, TFASTA, GAP, BESTFIT) and/or the comparison may be of the relative amount of a peptide or nucleic acid sequence in a pool of sequences determined from a polypeptide or nucleic acid sample of a specimen.

The invention also preferably provides a magnetic disk, such as an IBM-compatible (DOS, Windows, Windows95/98/2000, Windows NT, OS/2) or other format (e.g., Linux, SunOS, Solaris, AIX, SCO Unix, VMS, MV, Macintosh, etc.) floppy diskette or hard (fixed, Winchester) disk drive, comprising a bit pattern encoding data from an assay of the invention in a file format suitable for retrieval and processing in a computerized sequence analysis, comparison, or relative quantitation method.

The invention also provides a network, comprising a plurality of computing devices linked via a data link, such as an Ethernet cable (coax or 10BaseT), telephone line, ISDN line, wireless network, optical fiber, or other suitable signal transmission medium, whereby at least one network device (e.g., computer, disk array, etc.) comprises a pattern of magnetic domains (e.g., magnetic disk) and/or charge domains (e.g., an array of DRAM cells) composing a bit pattern encoding data acquired from an assay of the invention.

The invention also provides a method for transmitting assay data that includes generating an electronic signal on an electronic communications device, such as a modem, ISDN terminal adapter, DSL, cable modem, ATM switch, or the like, wherein the signal includes (in native or encrypted format) a bit pattern encoding data from an assay or a database comprising a plurality of assay results obtained by the method of the invention.

In a preferred embodiment, the invention provides a computer system for comparing a query target to a database containing an array of data structures, such as an assay result obtained by the method of the invention, and ranking database targets based on the degree of identity and gap weight to the target data. A central processor is preferably initialized to load and execute the computer program for alignment and/or comparison of the assay results. Data for a query target is entered into the central processor via an I/O device. Execution of the computer program results in the central processor retrieving the assay data from the data file, which comprises a binary description of an assay result.

The target data or record and the computer program can be transferred to secondary memory, which is typically random access memory (e.g., DRAM, SRAM, SGRAM, or SDRAM). Targets are ranked according to the degree of correspondence between a selected assay characteristic (e.g., binding to a selected affinity moiety) and the same characteristic of the query target and results are output via an I/O device. For example, a central processor can be a conventional computer (e.g., Intel Pentium, PowerPC, Alpha, PA-8000, SPARC, MIPS 4400, MIPS 10000, VAX, etc.); a program can be a commercial or public domain molecular biology software package (e.g., UWGCG Sequence Analysis Software, Darwin); a data file can be an optical or magnetic disk, a data server, a memory device (e.g., DRAM, SRAM, SGRAM, SDRAM, EPROM, bubble memory, flash memory, etc.); an I/O device can be a terminal comprising a video display and a keyboard, a modem, an ISDN terminal adapter, an Ethernet port, a punched card reader, a magnetic strip reader, or other suitable I/O device.

The invention also preferably provides the use of a computer system, e.g., which typically comprises one or more of: (1) a computer; (2) a stored bit pattern encoding a collection of peptide sequence specificity records obtained by methods of the inventions, which may be stored in the computer; (3) a comparison target, such as a query target; and (4) a program for alignment and comparison, typically with rank-ordering of comparison results on the basis of computed similarity values.

Characteristics of Ovarian Cancer-associated Proteins

Ovarian cancer proteins of the present invention may be categorized as secreted proteins, transmembrane proteins, or intracellular proteins. In one embodiment, the ovarian cancer protein is an intracellular protein. Intracellular proteins may be found in the cytoplasm and/or in the nucleus. Intracellular proteins are involved in all aspects of cellular function and replication (including, e.g., signaling pathways); aberrant expression of such proteins often results in unregulated or disregulated cellular processes. See, e.g., Alberts, et al. (eds. 1994) *Molecular Biology of the Cell* (3d ed.) Garland. For example, many intracellular proteins have enzymatic activity such as protein kinase activity, protein phosphatase activity, protease activity, nucleotide cyclase activity, polymerase activity, and the like. Intracellular proteins can also serve as docking proteins that are involved in organizing complexes of proteins, or targeting proteins to various subcellular localizations, and are often involved in maintaining the structural integrity of organelles.

An increasingly appreciated concept in characterizing proteins is the presence in the proteins of one or more structural motifs for which defined functions have been attributed. In addition to the highly conserved sequences found in the enzymatic domain of proteins, highly conserved sequences have been identified in proteins that are involved in protein-protein interaction. For example, Src-homology-2 (SH2) domains bind tyrosine-phosphorylated targets in a sequence dependent manner. PTB domains, which are distinct from SH2 domains, also bind tyrosine phosphorylated targets. SH3 domains bind to proline-rich targets. In addition, PH domains, tetratricopeptide repeats and WD domains to name only a few, have been shown to mediate protein-protein interactions. Some of these may also be involved in binding to phospholipids or other second messengers. As will be appreciated by one of ordinary skill in the art, these motifs can be identified on the basis of amino acid sequence; thus, an analysis of the sequence of proteins may provide insight into both the enzymatic potential of the molecule and/or molecules with which the protein may associate. One useful database is Pfam (protein families), which is a large collection of multiple sequence alignments and hidden Markov models covering many common protein domains. Versions are available via the internet from Washington University in St. Louis, the Sanger Center in England, and the Karolinska Institute in Sweden. See, e.g., Bateman, et al. (2000) *Nuc. Acids Res.* 28:263–266; Sonnhammer, et al. (1997) *Proteins* 28:405–420; Bateman, et al. (1999) *Nuc. Acids Res.* 27:260–262; and Sonnhammer, et al. (1998) *Nuc. Acids Res.* 26:320–322.

In another preferred embodiment, the ovarian cancer sequences are transmembrane proteins. Transmembrane proteins are molecules that span a phospholipid bilayer of a cell. They may have an intracellular domain, an extracellular domain, or both. The intracellular domains of such proteins may have a number of functions including those already described for intracellular proteins. For example, the intracellular domain may have enzymatic activity and/or may serve as a binding site for additional proteins. Frequently the intracellular domain of transmembrane proteins serves both roles. For example certain receptor tyrosine kinases have both protein kinase activity and SH2 domains. In addition, autophosphorylation of tyrosines on the receptor molecule itself, creates binding sites for additional SH2 domain containing proteins.

Transmembrane proteins may contain from one to many transmembrane domains. For example, receptor tyrosine kinases, certain cytokine receptors, receptor guanylyl cyclases and receptor serine/threonine protein kinases contain a single transmembrane domain. However, various other proteins including channels and adenylyl cyclases contain numerous transmembrane domains. Many important cell surface receptors such as G protein coupled receptors (GPCRs) are classified as "seven transmembrane domain" proteins, as they contain 7 membrane spanning regions. Characteristics of transmembrane domains include approximately 17 consecutive hydrophobic amino acids that may be followed by charged amino acids. Therefore, upon analysis of the amino acid sequence of a particular protein, the localization and number of transmembrane domains within the protein may be predicted (see, e.g., PSORT web site psort.nibb.ac.jp. Important transmembrane protein receptors include, but are not limited to the insulin receptor, insulin-like growth factor receptor, human growth hormone receptor, glucose transporters, transferrin receptor, epidermal growth factor receptor, low density lipoprotein receptor, epidermal growth factor receptor, leptin receptor, interleukin receptors, e.g., IL-1 receptor, IL-2 receptor, etc.

The extracellular domains of transmembrane proteins are diverse; however, conserved motifs are found repeatedly among various extracellular domains. Conserved structure and/or functions have been ascribed to different extracellular motifs. Many extracellular domains are involved in binding to other molecules. In one aspect, extracellular domains are found on receptors. Factors that bind the receptor domain include circulating ligands, which may be peptides, proteins, or small molecules such as adenosine and the like. For example, growth factors such as EGF, FGF, and PDGF are circulating growth factors that bind to their cognate receptors to initiate a variety of cellular responses. Other factors include cytokines, mitogenic factors, neurotrophic factors and the like. Extracellular domains also bind to cell-associated molecules, or may be processed or shed to the blood stream. In this respect, they can mediate cell-cell interactions. Cell-associated ligands can be tethered to the cell, e.g., via a glycosylphosphatidylinositol (GPI) anchor, or may themselves be transmembrane proteins. Extracellular domains also associate with the extracellular matrix and contribute to the maintenance of the cell structure.

Ovarian cancer proteins that are transmembrane are particularly preferred in the present invention as they are readily accessible targets for immunotherapeutics, as are described herein. In addition, as outlined below, transmembrane proteins can be also useful in imaging modalities. Antibodies may be used to label such readily accessible proteins in situ. Alternatively, antibodies can also label intracellular proteins, in which case samples are typically permeablized to provide access to intracellular proteins. In addition, some membrane proteins can be processed to release a soluble protein, or to expose a residual fragment. Released soluble proteins may be useful diagnostic markers, processed residual protein fragments may be useful ovarian markers of disease.

It will also be appreciated by those in the art that a transmembrane protein can be made soluble by removing transmembrane sequences, e.g., through recombinant methods. Furthermore, transmembrane proteins that have been made soluble can be made to be secreted through recombinant means by adding an appropriate signal sequence.

In another embodiment, the ovarian cancer proteins are secreted proteins; the secretion of which can be either constitutive or regulated. These proteins may have a signal peptide or signal sequence that targets the molecule to the secretory pathway. Secreted proteins are involved in numerous physiological events; e.g., if circulating, they often serve to transmit signals to various other cell types. The secreted protein may function in an autocrine manner (acting on the cell that secreted the factor), a paracrine manner (acting on cells in close proximity to the cell that secreted the factor), an endocrine manner (acting on cells at a distance, e.g., secretion into the blood stream), or exocrine (secretion, e.g., through a duct or to an adjacent epithelial surface as sweat glands, sebaceous glands, pancreatic ducts, lacrimal glands, mammary glands, wax producing glands of the ear, etc.). Thus, secreted molecules often find use in modulating or altering numerous aspects of physiology. Ovarian cancer proteins that are secreted proteins are particularly preferred as good diagnostic markers, e.g., for blood, plasma, serum, or stool tests. Those which are enzymes may be antibody or small molecule therapeutic targets. Others may be useful as vaccine targets, e.g., via CTL mechanisms, as protein or DNA vaccines.

Use of Ovarian Cancer Nucleic Acids

As described above, ovarian cancer sequence is initially identified by substantial nucleic acid and/or amino acid sequence homology or linkage to the ovarian cancer sequences outlined herein. Such homology can be based upon the overall nucleic acid or amino acid sequence, and is generally determined as outlined below, using either homology programs or hybridization conditions. Typically, linked sequences on a mRNA are found on the same molecule.

The ovarian cancer nucleic acid sequences of the invention, e.g., in Table 1–20, can be fragments of larger genes, e.g., they are nucleic acid segments. "Genes" in this context includes coding regions, non-coding regions, and mixtures of coding and non-coding regions. Accordingly, as will be appreciated by those in the art, using the sequences provided herein, extended sequences, in either direction, of the ovarian cancer genes can be obtained, using techniques well known in the art for cloning either longer sequences or the full length sequences; see Ausubel, et al., supra. Much can be done by informatics and many sequences can be clustered to include multiple sequences corresponding to a single gene, e.g., systems such as UniGene (see, www.ncbi.nlm.nih.gov/UniGene/).

Once the ovarian cancer nucleic acid is identified, it can be cloned and, if necessary, its constituent parts recombined to form the entire ovarian cancer nucleic acid coding regions or the entire mRNA sequence. Once isolated from its natural source, e.g., contained within a plasmid or other vector or excised as a linear nucleic acid segment, the recombinant ovarian cancer nucleic acid can be further-used as a probe to identify and isolate other ovarian cancer nucleic acids, e.g., extended coding regions. It can also be used as a "precursor" nucleic acid to make modified or variant ovarian cancer nucleic acids and proteins.

The ovarian cancer nucleic acids of the present invention are useful in several ways. In a first embodiment, nucleic acid probes to the ovarian cancer nucleic acids are made and attached to biochips to be used in screening and diagnostic methods, as outlined below, or for administration, e.g., for gene therapy, vaccine, RNAi, and/or antisense applications. Alternatively, the ovarian cancer nucleic acids that include coding regions of ovarian cancer proteins can be put into expression vectors for the expression of ovarian cancer proteins, again for screening purposes or for administration to a patient.

In a preferred embodiment, nucleic acid probes to ovarian cancer nucleic acids (both the nucleic acid sequences outlined in the figures and/or the complements thereof) are made. The nucleic acid probes attached to the biochip are designed to be substantially complementary to the ovarian cancer nucleic acids, e.g., the target sequence (either the target sequence of the sample or to other probe sequences, e.g., in sandwich assays), such that hybridization of the target sequence and the probes of the present invention occurs. As outlined below, this complementarity need not be perfect; there may be any number of base pair mismatches which will interfere with hybridization between the target sequence and the single stranded nucleic acids of the present invention. However, if the number of mutations is so great that no hybridization can occur under even the least stringent of hybridization conditions, the sequence is not a complementary target sequence. Thus, by "substantially complementary" herein is meant that the probes are sufficiently complementary to the target sequences to hybridize under normal reaction conditions, particularly high stringency conditions, as outlined herein.

A nucleic acid probe is generally single stranded but can be partially single and partially double stranded. The strandedness of the probe is dictated by the structure, composition, and properties of the target sequence. In general, the nucleic acid probes range from about 8 to about 100 bases long, with from about 10 to about 80 bases being preferred, and from about 30 to about 50 bases being particularly preferred. That is, generally whole genes are not used. In some embodiments, much longer nucleic acids can be used, up to hundreds of bases.

In a preferred embodiment, more than one probe per sequence is used, with either overlapping probes or probes to different sections of the target being used. That is, two, three, four or more probes, with three being preferred, are used to build in a redundancy for a particular target. The probes can be overlapping (e.g., have some sequence in common), or separate. In some cases, PCR primers may be used to amplify signal for higher sensitivity.

As will be appreciated by those in the art, nucleic acids can be attached or immobilized to a solid support in a wide variety of ways. By "immobilized" and grammatical equivalents herein is meant the association or binding between the nucleic acid probe and the solid support is sufficient to be stable under the conditions of binding, washing, analysis, and removal as outlined below. The binding can typically be covalent or non-covalent. By "non-covalent binding" and grammatical equivalents herein is meant one or more of electrostatic, hydrophilic, and hydrophobic interactions. Included in non-covalent binding is the covalent attachment of a molecule, such as, streptavidin to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilization may also involve a combination of covalent and non-covalent interactions.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid substrate. By "substrate" or "solid support" or other grammatical equivalents herein is meant a material that can be modified to contain discrete individual sites appropriate for the attachment or association of the nucleic acid probes and is amenable to at least one detection method. As will be appreciated by those in the art, the number of possible substrates are very large, and include, but are not limited to, glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses, plastics, etc. In general, the substrates allow optical detection and do not appreciably fluoresce. See, e.g., WO0055627 Reusable Low Fluorescent Plastic Biochip.

Generally the substrate is planar, although as will be appreciated by those in the art, other configurations of substrates may be used as well. For example, the probes may be placed on the inside surface of a tube, for flow-through sample analysis to minimize sample volume. Similarly, the substrate may be flexible, such as a flexible foam, including closed cell foams made of particular plastics.

In a preferred embodiment, the surface of the biochip and the probe may be derivatized with chemical functional groups for subsequent attachment of the two. Thus, e.g., the biochip is derivatized with a chemical functional group including, but not limited to, amino groups, carboxyl groups, oxo groups and thiol groups, with amino groups being particularly preferred. Using these functional groups, the probes can be attached using functional groups on the probes. For example, nucleic acids containing amino groups can be attached to surfaces comprising amino groups, e.g., using linkers as are known in the art; e.g., homo-or heterobifunctional linkers as are well known (see 1994 Pierce Chemical Company catalog, technical section on crosslinkers, pages 155–200). In addition, in some cases, additional linkers, such as alkyl groups (including substituted and heteroalkyl groups) may be used.

In this embodiment, oligonucleotides are synthesized as is known in the art, and then attached to the surface of the solid support. As will be appreciated by those skilled in the art, either the 5' or 3' terminus may be attached to the solid support, or attachment may be via an internal nucleoside.

In another embodiment, the immobilization to the solid support may be very strong, yet non-covalent. For example, biotinylated oligonucleotides can be made, which bind to surfaces covalently coated with streptavidin, resulting in attachment.

Alternatively, the oligonucleotides may be synthesized on the surface, as is known in the art. For example, photoactivation techniques utilizing photopolymerization compounds and techniques are used. In a preferred embodiment, the nucleic acids can be synthesized in situ, using well known photolithographic techniques, such as those described in WO 95/25116; WO 95/35505; U.S. Pat. Nos. 5,700,637 and 5,445,934; and references cited within, all of which are expressly incorporated by reference; these methods of attachment form the basis of the Affymetrix GeneChip™ technology.

Often, amplification-based assays are performed to measure the expression level of ovarian cancer-associated sequences. These assays are typically performed in conjunction with reverse transcription. In such assays, an ovarian cancer-associated nucleic acid sequence acts as a template in an amplification reaction (e.g., Polymerase Chain Reaction, or PCR). In a quantitative amplification, the amount of amplification product will be proportional to the amount of template in the original sample. Comparison to appropriate controls provides a measure of the amount of ovarian cancer-associated RNA. Methods of quantitative amplification are well known to those of skill in the art. Detailed protocols for quantitative PCR are available. See, e.g., Innis, et al.(1990) *PCR Protocols: A Guide to Methods and Applications* Academic Press.

In some embodiments, a TaqMan based assay is used to measure expression. TaqMan based assays use a fluorogenic oligonucleotide probe that contains a 5' fluorescent dye and a 3' quenching agent. The probe hybridizes to a PCR product, but cannot itself be extended due to a blocking agent at the 3' end. When the PCR product is amplified in subsequent cycles, the 5' nuclease activity of the polymerase, e.g., AmpliTaq, results in the cleavage of the TaqMan probe. This cleavage separates the 5' fluorescent dye and the 3' quenching agent, thereby resulting in an increase in fluorescence as a function of amplification (see, e.g., literature provided by Perkin-Elmer, e.g., www2.perkinelmer.com).

Other suitable amplification methods include, but are not limited to, ligase chain reaction (LCR; see Wu and Wallace (1989) *Genomics* 4:560–569; Landegren, et al. (1988) *Science* 241:1077–1980; and Barringer, et al. (1990) *Gene* 89:117–122), transcription amplification (Kwoh, et al. (1989) *Proc. Nat'l Acad. Sci. USA* 86:1173–1177), self-sustained sequence replication (Guatelli, et al. (1990) *Proc. Nat'l Acad. Sci. USA* 87:1874–1878), dot PCR, linker adapter PCR, etc.

Expression of Ovarian Cancer Proteins from Nucleic Acids

In a preferred embodiment, ovarian cancer nucleic acids, e.g., encoding ovarian cancer proteins are used to make a variety of expression vectors to express ovarian cancer proteins which can then be used in screening assays, as described below. Expression vectors and recombinant DNA technology are well known and are used to express proteins. See, e.g., Ausubel, supra; and Fernandez and Hoeffler (eds. 1999) *Gene Expression Systems* Academic Press. The expression vectors may be either self-replicating extrachromosomal vectors or vectors which integrate into a host genome. Generally, these expression vectors include transcriptional and translational regulatory nucleic acid operably linked to the nucleic acid encoding the ovarian cancer protein. The term "control sequences" refers to DNA sequences used for the expression of an operably linked coding sequence in a particular host organism. Control sequences that are suitable for prokaryotes, e.g., include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; a ribosome binding site is operably linked to a coding sequence if it is positioned so as to facilitate translation; and two sequences may be operably linked when they are physically part of the same polymer. Generally, "operably linked" means that the DNA sequences being linked are contiguous, and, in the case of a secretory leader, contiguous and in reading phase. However, enhancers do not have to be contiguous. Linking is typically accomplished by ligation at convenient restriction sites. If such sites do not exist, synthetic oligonucleotide adaptors or linkers are used in accordance with conventional practice. Transcriptional and translational regulatory nucleic acid will generally be appropriate to the host cell used to express the ovarian cancer protein. Numerous types of appropriate expression vectors, and suitable regulatory sequences are known in the art for a variety of host cells.

In general, transcriptional and translational regulatory sequences may include, but are not limited to, promoter sequences, ribosomal binding sites, transcriptional start and stop sequences, translational start and stop sequences, and enhancer or activator sequences. In a preferred embodiment, the regulatory sequences include a promoter and transcriptional start and stop sequences.

Promoter sequences typically encode constitutive or inducible promoters. The promoters may be naturally occurring promoters or hybrid promoters. Hybrid promoters, which combine elements of more than one promoter, are also known in the art, and are useful in the present invention.

In addition, an expression vector may comprise additional elements. For example, the expression vector may have two replication systems, thus allowing it to be maintained in two organisms, e.g., in mammalian or insect cells for expression and in a procaryotic host for cloning and amplification. Furthermore, for integrating expression vectors, the expression vector contains at least one sequence homologous to the host cell genome, and preferably two homologous sequences which flank the expression construct. The integrating vector may be directed to a specific locus in the host cell by selecting the appropriate homologous sequence for inclusion in the vector. Constructs for integrating vectors are available. See, e.g., Fernandez and Hoeffler, supra.

In addition, in a preferred embodiment, the expression vector contains a selectable marker gene to allow the selection of transformed host cells. Selection genes are well known in the art and will vary with the host cell used.

The ovarian cancer proteins of the present invention are produced by culturing a host cell transformed with an expression vector containing nucleic acid encoding an ovarian cancer protein, under the appropriate conditions to induce or cause expression of the ovarian cancer protein. Conditions appropriate for ovarian cancer protein expression will vary with the choice of the expression vector and the host cell, and will be easily ascertained by one skilled in the art through routine experimentation or optimization. For example, the use of constitutive promoters in the expression vector will require optimizing the growth and proliferation of the host cell, while the use of an inducible promoter requires the appropriate growth conditions for induction. In addition, in some embodiments, the timing of the harvest is important. For example, the baculovirus systems used in insect cell expression are lytic viruses, and thus harvest time selection can be crucial for product yield.

Appropriate host cells include yeast, bacteria, archaebacteria, fungi, and insect and animal cells, including mammalian cells. Of particular interest are Saccharomyces cerevisiae and other yeasts, *E. coli, Bacillus subtilis*, Sf9 cells, C129 cells, 293 cells, Neurospora, BHK, CHO, COS, HeLa cells, HUVEC (human umbilical vein endothelial cells), THP1 cells (a macrophage cell line) and various other human cells and cell lines.

In a preferred embodiment, the ovarian cancer proteins are expressed in mammalian cells. Mammalian expression systems are also known in the art, and include retroviral and adenoviral systems. One expression vector system is a retroviral vector system such as is generally described in PCT/US97/01019 and PCT/US97/01048, both of which are hereby expressly incorporated by reference. Of particular use as mammalian promoters are the promoters from mammalian viral genes, since the viral genes are often highly expressed and have a broad host range. Examples include the SV40 early promoter, mouse mammary tumor virus LTR promoter, adenovirus major late promoter, herpes simplex virus promoter, and the CMV promoter. See, e.g., Fernandez and Hoeffler, supra. Typically, transcription termination and polyadenylation sequences recognized by mammalian cells are regulatory regions located 3' to the translation stop codon and thus, together with the promoter elements, flank the coding sequence. Examples of transcription terminator and polyadenylation signals include those derived form SV40.

The methods of introducing exogenous nucleic acid into mammalian hosts, as well as other hosts, is well known in the art, and will vary with the host cell used. Techniques include dextran-mediated transfection, calcium phosphate precipitation, polybrene mediated transfection, protoplast fusion, electroporation, encapsulation of the polynucleotide(s) in liposomes, and direct microinjection of the DNA into nuclei.

In a preferred embodiment, ovarian cancer proteins are expressed in bacterial systems. Bacterial expression systems are well known in the art. Promoters from bacteriophage may also be used and are known in the art. In addition, synthetic promoters and hybrid promoters are also useful; e.g., the tac promoter is a hybrid of the trp and lac promoter sequences. Furthermore, a bacterial promoter can include naturally occurring promoters of non-bacterial origin that have the ability to bind bacterial RNA polymerase and initiate transcription. In addition to a functioning promoter sequence, an efficient ribosome binding site is desirable. The expression vector may also include a signal peptide sequence that provides for secretion of the ovarian cancer protein in bacteria. The protein is either secreted into the growth media (gram-positive bacteria) or into the periplasmic space, located between the inner and outer membrane of the cell (gram-negative bacteria). The bacterial expression vector may also include a selectable marker gene to allow for the selection of bacterial strains that have been transformed. Suitable selection genes include genes which render the bacteria resistant to drugs such as ampicillin, chloramphenicol, erythromycin, kanamycin, neomycin, and tetracycline. Selectable markers also include biosynthetic genes, such as those in the histidine, tryptophan, and leucine biosynthetic pathways. These components are assembled into expression vectors. Expression vectors for bacteria are well known in the art, and include vectors for *Bacillus subtilis, E. coli, Streptococcus cremoris*, and *Streptococcus lividans*, among others. See Fernandez and Hoeffler, supra. The bacterial expression vectors are transformed into bacterial host cells using techniques well known in the art, such as calcium chloride treatment, electroporation, and others.

In one embodiment, ovarian cancer proteins are produced in insect cells. Expression vectors for the transformation of insect cells, and in particular, baculovirus-based expression vectors, are well known in the art.

In a preferred embodiment, an ovarian cancer protein is produced in yeast cells. Yeast expression systems are well known in the art, and include expression vectors for *Saccharomyces cerevisiae, Candida albicans* and *C. maltosa, Hansenula polymorpha, Kluyveromyces fragilis* and *K. lactis, Pichia guillerimondii* and *P. pastoris, Schizosaccharomyces pombe*, and *Yarrowia lipolytica*.

The ovarian cancer protein may also be made as a fusion protein, using techniques well known in the art. Thus, e.g., for the creation of monoclonal antibodies, if the desired epitope is small, the ovarian cancer protein may be fused to a carrier protein to form an immunogen. Alternatively, the ovarian cancer protein may be made as a fusion protein to increase expression, or for other reasons. For example, when the ovarian cancer protein is an ovarian cancer peptide, the nucleic acid encoding the peptide may be linked to other nucleic acid for expression purposes.

In a preferred embodiment, the ovarian cancer protein is purified or isolated after expression. Ovarian cancer proteins may be isolated or purified in a variety of ways known to those skilled in the art depending on what other components are present in the sample. Standard purification methods include electrophoretic, molecular, immunological and chromatographic techniques, including ion exchange, hydrophobic, affinity, and reverse-phase HPLC chromatography, and chromatofocusing. For example, the ovarian cancer protein may be purified using a standard anti-ovarian cancer protein antibody column. Ultrafiltration and diafiltration techniques, in conjunction with protein concentration, are also useful. For general guidance in suitable purification techniques, see Scopes (1982) *Protein Purification* Springer-Verlag. The degree of purification necessary will vary depending on the use of the ovarian cancer protein. In some instances no purification will be necessary.

Once expressed and purified if necessary, the ovarian cancer proteins and nucleic acids are useful in a number of applications. They may be used as immunoselection reagents, as vaccine reagents, as screening agents, etc.

Variants of Ovarian Cancer Proteins

In one embodiment, the ovarian cancer proteins are derivative or variant ovarian cancer proteins as compared to the wild-type sequence. That is, as outlined more fully below, the derivative ovarian cancer peptide will often contain at least one amino acid substitution, deletion or insertion, with amino acid substitutions being particularly preferred. The amino acid substitution, insertion, or deletion may occur at most any residue within the ovarian cancer peptide.

Also included within one embodiment of ovarian cancer proteins of the present invention are amino acid sequence variants. These variants typically fall into one or more of three classes: substitutional, insertional or deletional variants. These variants ordinarily are prepared by site specific mutagenesis of nucleotides in the DNA encoding the ovarian cancer protein, using cassette or PCR mutagenesis or other techniques well known in the art, to produce DNA encoding the variant, and thereafter expressing the DNA in recombinant cell culture as outlined above. However, variant ovarian cancer protein fragments having up to about 100–150 residues may be prepared by in vitro synthesis using established techniques. Amino acid sequence variants are characterized by the predetermined nature of the variation, a feature that sets them apart from naturally occurring allelic or interspecies variation of the ovarian cancer protein amino acid sequence. The variants typically exhibit the same qualitative biological activity as the naturally occurring analogue, although variants can also be selected which have modified characteristics as will be more fully outlined below.

While the site or region for introducing an amino acid sequence variation is predetermined, the mutation per se need not be predetermined. For example, in order to optimize the performance of a mutation at a given site, random mutagenesis may be conducted at the target codon or region and the expressed ovarian cancer variants screened for the optimal combination of desired activity. Techniques for making substitution mutations at predetermined sites in DNA having a known sequence are well known, e.g., M13 primer mutagenesis and PCR mutagenesis. Screening of the mutants is done using assays of ovarian cancer protein activities.

Amino acid substitutions are typically of single residues; insertions usually will be on the order of from about 1 to 20 amino acids, although considerably larger insertions may be tolerated. Deletions range from about 1 to about 20 residues, although in some cases deletions may be much larger.

Substitutions, deletions, insertions or any combination thereof may be used to arrive at a final derivative. Generally these changes are done on a few amino acids to minimize the alteration of the molecule. However, larger changes may be tolerated in certain circumstances. When small alterations in the characteristics of the ovarian cancer protein are desired, substitutions are generally made in accordance with the amino acid substitution relationships provided in the definition section.

The variants typically exhibit the same qualitative biological activity and will elicit the same immune response as the naturally-occurring analog, although variants also are selected to modify the characteristics of the ovarian cancer proteins as needed. Alternatively, the variant may be designed such that the biological activity of the ovarian cancer protein is altered. For example, glycosylation sites may be altered or removed.

Substantial changes in function or immunological identity are made by selecting substitutions that are less conservative than those described above. For example, substitutions may be made which more significantly affect: the structure of the polypeptide backbone in the area of the alteration, for example the alpha-helical or beta-sheet structure; the charge or hydrophobicity of the molecule at the target site; or the bulk of the side chain. The substitutions which in general are expected to produce the greatest changes in the polypeptide's properties are those in which (a) a hydrophilic residue, e.g., serine or threonine is substituted for (or by) a hydrophobic residue, e.g., leucine, isoleucine, phenylalanine, valine, or alanine; (b) a cysteine or proline is substituted for (or by) any other residue; (c) a residue having an electropositive side chain, e.g., lysine, arginine, or histidine, is substituted for (or by) an electronegative residue, e.g., glutamic or aspartic acid; (d) a residue having a bulky side chain, e.g., phenylalanine, is substituted for (or by) one not having a side chain, e.g., glycine; or (e) a proline residue is incorporated or substituted, which changes the degree of rotational freedom of the peptidyl bond.

Covalent modifications of ovarian cancer polypeptides are included within the scope of this invention. One type of covalent modification includes reacting targeted amino acid residues of an ovarian cancer polypeptide with an organic derivatizing agent that is capable of reacting with selected side chains or the N-or C-terminal residues of an ovarian cancer polypeptide. Derivatization with bifunctional agents is useful, for instance, for crosslinking ovarian cancer polypeptides to a water-insoluble support matrix or surface for use in the method for purifying anti-ovarian cancer polypeptide antibodies or screening assays, as is more fully described below. Commonly used crosslinking agents include, e.g., 1,1-bis(diazoacetyl)-2-phenylethane, glutaraldehyde, N-hydroxysuccinimide esters, e.g., esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-((p-azidophenyl)dithio)propioimidate.

Other modifications include deamidation of glutamine and asparagine residues to the corresponding glutamic and aspartic acid residues, respectively, hydroxylation of proline and lysine, phosphorylation of hydroxyl groups of serine, threonine, or tyrosine residues, methylation of the amino groups of the lysine, arginine, and histidine side chains (e.g., pp. 79–86, Creighton (1983) *Proteins: Structure and Molecular Properties* Freeman), acetylation of the N-terminal amine, and amidation of a C-terminal carboxyl group.

Another type of covalent modification of the ovarian cancer polypeptide included within the scope of this invention comprises altering the native glycosylation pattern of the polypeptide. "Altering the native glycosylation pattern" is intended for purposes herein to mean deleting one or more carbohydrate moieties found in native sequence ovarian cancer polypeptide, and/or adding one or more glycosylation sites that are not present in the native sequence ovarian cancer polypeptide. Glycosylation patterns can be altered in many ways. For example the use of different cell types to express ovarian cancer-associated sequences can result in different glycosylation patterns.

Addition of glycosylation sites to ovarian cancer polypeptides may also be accomplished by altering the amino acid sequence thereof. The alteration may be made, e.g., by the addition of, or substitution by, one or more serine or threonine residues to the native sequence ovarian cancer polypeptide (for O-linked glycosylation sites). The ovarian cancer amino acid sequence may optionally be altered through changes at the DNA level, particularly by mutating the DNA encoding the ovarian cancer polypeptide at pre-selected bases such that codons are generated that will translate into the desired amino acids.

Another means of increasing the number of carbohydrate moieties on the ovarian cancer polypeptide is by chemical or enzymatic coupling of glycosides to the polypeptide. See, e.g., WO 87/05330, and pp. 259–306 in Aplin and Wriston (1981) CRC Crit. Rev. Biochem. CRC Press.

Removal of carbohydrate moieties present on the ovarian cancer polypeptide may be accomplished chemically or enzymatically or by mutational substitution of codons encoding for amino acid residues that serve as targets for glycosylation. Chemical deglycosylation techniques are applicable. See, e.g., Sojar and Bahl (1987) Arch. Biochem. Biophys. 259:52–57; and Edge, et al. (1981) Anal. Biochem. 118:131–137. Enzymatic cleavage of carbohydrate moieties on polypeptides can be achieved by the use of a variety of endo- and exo-glycosidases. See, e.g., Thotakura, et al. (1987) Meth. Enzymol., 138:350–359.

Another type of covalent modification of ovarian cancer comprises linking the ovarian cancer polypeptide to one of a variety of non-proteinaceous polymers, e.g., polyethylene glycol, polypropylene glycol, or polyoxyalkylene. See, e.g., U.S. Pat. Nos. 4,640,835; 4,496,689; 4,301,144; 4,670,417; 4,791,192; or 4,179,337.

Ovarian cancer polypeptides of the present invention may also be modified in a way to form chimeric molecules, e.g., comprising an ovarian cancer polypeptide fused to another heterologous polypeptide or amino acid sequence. In one embodiment, such a chimeric molecule comprises a fusion of an ovarian cancer polypeptide with a tag polypeptide which provides an epitope to which an anti-tag antibody can selectively bind. The epitope tag is generally placed at the amino-or carboxyl-terminus of the ovarian cancer polypeptide. The presence of such epitope-tagged forms of an ovarian cancer polypeptide can be detected using an antibody against the tag polypeptide. Also, provision of the epitope tag enables the ovarian cancer polypeptide to be readily purified by affinity purification using an anti-tag antibody or another type of affinity matrix that binds to the epitope tag. In an alternative embodiment, the chimeric molecule may comprise a fusion of an ovarian cancer polypeptide with an immunoglobulin or a particular region of an immunoglobulin. For a bivalent form of the chimeric molecule, such a fusion could be to the Fc region of an IgG molecule.

Various tag polypeptides and their respective antibodies are well known in the art. Examples include poly-histidine (poly-his) or poly-histidine-glycine (poly-his-gly) tags; His6 (SEQ ID NO:161) and metal chelation tags, the flu HA tag polypeptide and its antibody 12CA5 (Field, et al. (1988) Mol. Cell. Biol. 8:2159–2165); the c-myc tag and the 8F9, 3C7, 6E10, G4, B7, and 9E10 antibodies thereto (Evan, et al. (1985) Mol. Cell. Biol. 5:3610–3616); and the Herpes Simplex virus glycoprotein D (gD) tag and its antibody (Paborsky, et al. (1990) Protein Engineering 3:547–553). Other tag polypeptides include, e.g., the Flag-peptide (Hopp, et al. (1988) BioTechnology 6:1204–1210); the KT3 epitope peptide (Martin, et al. (1992) Science 255:192–194); tubulin epitope peptide (Skinner, et al. (1991) J. Biol. Chem. 266: 15163–15166); and the T7 gene 10 protein peptide tag (Lutz-Freyermuth et al. (1990) Proc. Nat'l Acad. Sci. USA 87:6393–6397).

Also included are other ovarian cancer proteins of the ovarian cancer family, and ovarian cancer proteins from other organisms, which are cloned and expressed as outlined below. Thus, probe or degenerate polymerase chain reaction (PCR) primer sequences may be used to find other related ovarian cancer proteins from humans or other organisms. As will be appreciated by those in the art, particularly useful probe and/or PCR primer sequences include the unique areas of the ovarian cancer nucleic acid sequence. As is generally known in the art, preferred PCR primers are from about 15 to about 35 nucleotides in length, with from about 20 to about 30 being preferred, and may contain inosine as needed. The conditions for the PCR reaction are well known in the art (e.g., Innis, PCR Protocols, supra).

Antibodies to Ovarian Cancer Proteins

In a preferred embodiment, when the ovarian cancer protein is to be used to generate antibodies, e.g., for immunotherapy or immunodiagnosis, the ovarian cancer protein should share at least one epitope or determinant with the full length protein. By "epitope" or "determinant" herein is typically meant a portion of a protein which will generate and/or bind an antibody or T-cell receptor in the context of MHC. Thus, in most instances, antibodies made to a smaller ovarian cancer protein will be able to bind to the full-length protein, particularly linear epitopes. In a preferred embodiment, the epitope is unique; that is, antibodies generated to a unique epitope show little or no cross-reactivity.

Methods of preparing polyclonal antibodies are known to the skilled artisan (e.g., Coligan, supra; and Harlow and Lane, supra). Polyclonal antibodies can be raised in a mammal, e.g., by one or more injections of an immunizing agent and, if desired, an adjuvant. Typically, the immunizing agent and/or adjuvant will be injected in the mammal by multiple subcutaneous or intraperitoneal injections. The immunizing agent may include a protein encoded by a nucleic acid of the figures or fragment thereof or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

The antibodies may, alternatively, be monoclonal antibodies. Monoclonal antibodies may be prepared using hybridoma methods, such as those described by Kohler and Milstein (1975) Nature 256:495–497. In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro. The immunizing agent will typically include a polypeptide encoded by a nucleic acid of Tables 1–20 or fragment thereof, or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (e.g., pp. 59–103 in Goding (1986) *Monoclonal Antibodies: Principles and Practice* Academic Press). Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

In one embodiment, the antibodies are bispecific antibodies. Bispecific antibodies are monoclonal, preferably human or humanized, antibodies that have binding specificities for at least two different antigens or that have binding specificities for two epitopes on the same antigen. In one embodiment, one of the binding specificities is for a protein encoded by a nucleic acid Table 1–20 or a fragment thereof, the other one is for any other antigen, and preferably for a cell-surface protein or receptor or receptor subunit, preferably one that is tumor specific. Alternatively, tetramer-type technology may create multivalent reagents.

In a preferred embodiment, the antibodies to ovarian cancer protein are capable of reducing or eliminating a biological function of an ovarian cancer protein, as is described below. That is, the addition of anti-ovarian cancer protein antibodies (either polyclonal or preferably monoclonal) to ovarian cancer tissue (or cells containing ovarian cancer) may reduce or eliminate the ovarian cancer. Generally, at least a 25% decrease in activity, growth, size or the like is preferred, with at least about 50% being particularly preferred and about a 95–100% decrease being especially preferred.

In a preferred embodiment the antibodies to the ovarian cancer proteins are humanized antibodies (e.g., Xenerex Biosciences; Medarex, Inc.; Abgenix, Inc.; Protein Design Labs, Inc.) Humanized forms of non-human (e.g., murine) antibodies are chimeric molecules of immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, a humanized antibody will comprise substantially all of at least one, and typically two, variable domains, in which all or substantially all of the CDR regions correspond to those of a non-human immunoglobulin and all or substantially all of the framework (FR) regions are those of a human immunoglobulin consensus sequence. The humanized antibody optimally also will comprise at least a portion of an immunoglobulin constant region (Fc), typically that of a human immunoglobulin. Humanization can be essentially performed following the method of Winter and co-workers, e.g., by substituting rodent CDRs or CDR sequences for the corresponding sequences of a human antibody. See, e.g., Jones, et al. (1986) *Nature* 321:522–525; Riechmann, et al. (1988) *Nature* 332:323–329; Presta (1992) *Curr. Op. Struct. Biol.* 2:593–596; and Verhoeyen, et al. (1988) *Science* 239:1534–1536). Accordingly, such humanized antibodies are chimeric antibodies (U.S. Pat. No. 4,816,567), wherein substantially less than an intact human variable domain has been substituted by the corresponding sequence from a non-human species.

Human antibodies can also be produced using various techniques known in the art, including phage display libraries (see, e.g., Hoogenboom and Winter (1991) *J. Mol. Biol.* 227:381–388; and Marks, et al. (1991) *J. Mol. Biol.* 222: 581–597) or human monoclonal antibodies (see, e.g., p. 77, Cole, et al. in Reisfeld and Sell (1985) *Monoclonal Antibodies and Cancer Therapy* Liss; and Boerner, et al. (1991) *J. Immunol.* 147:86–95). Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. See, e.g., U.S. Pat. Nos. 5,545,807; 5,545, 806; 5,569,825; 5,625,126; 5,633,425; 5,661,016; Marks, et al. (1992) *Bio/Technology* 10:779–783; Lonberg, et al. (1994) *Nature* 368:856–859; Morrison (1994) *Nature* 368: 812–13; Neuberger (1996) *Nature Biotechnology* 14:826 commenting on Fishwild, et al. (1996) *Nature Biotechnology* 14:845–51; and Lonberg and Huszar (1995) *Intern. Rev. Immunol.* 13:65–93.

By immunotherapy is meant treatment of ovarian cancer, e.g., with an antibody raised against ovarian cancer proteins. As used herein, immunotherapy can be passive or active. Passive immunotherapy as defined herein is the passive transfer of antibody to a recipient (patient). Active immunization is the induction of antibody and/or T-cell responses in a recipient (patient). Induction of an immune response is the result of providing the recipient with an antigen to which antibodies are raised. The antigen may be provided by injecting a polypeptide against which antibodies are desired to be raised into a recipient, or contacting the recipient with a nucleic acid capable of expressing the antigen and under conditions for expression of the antigen, leading to an immune response.

In a preferred embodiment the ovarian cancer proteins against which antibodies are raised are secreted proteins as described above. Without being bound by theory, antibodies used for treatment, bind and prevent the secreted protein from binding to its receptor, thereby inactivating the secreted ovarian cancer protein.

In another preferred embodiment, the ovarian cancer protein to which antibodies are raised is a transmembrane protein. Without being bound by theory, antibodies used for treatment, bind the extracellular domain of the ovarian cancer protein and prevent it from binding to other proteins, such as circulating ligands or cell-associated molecules. The antibody may cause down-regulation of the transmembrane ovarian cancer protein. As will be appreciated by one of ordinary skill in the art, the antibody may be a competitive, non-competitive or uncompetitive inhibitor of protein binding to the extracellular domain of the ovarian cancer protein. The antibody is also an antagonist of the ovarian cancer protein. Further, the antibody prevents activation of the transmembrane ovarian cancer protein. In one aspect, when the antibody prevents the binding of other molecules to the ovarian cancer protein, the antibody prevents growth of the cell. The antibody may also be used to target or sensitize the cell to cytotoxic agents, including, but not limited to TNF-α, TNF-β, IL-1, INF-γ, and IL-2, or chemotherapeutic agents including 5FU, vinblastine, actinomycin D, cisplatin, methotrexate, and the like. In some instances the antibody belongs to a sub-type that activates serum complement when complexed with the transmembrane protein thereby mediating cytotoxicity or antigen-dependent cytotoxicity (ADCC). Thus, ovarian cancer is treated by administering to a patient antibodies directed against the transmembrane ovarian cancer protein. Antibody-labeling may activate a co-toxin, localize a toxin payload, or otherwise provide means to locally ablate cells.

In another preferred embodiment, the antibody is conjugated to an effector moiety. The effector moiety can be any number of molecules, including labeling moieties such as radioactive labels or fluorescent labels, or can be a therapeutic moiety. In one aspect the therapeutic moiety is a small molecule that modulates the activity of the ovarian cancer protein. In another aspect the therapeutic moiety modulates the activity of molecules associated with or in close proximity to the ovarian cancer protein. The therapeutic moiety may inhibit enzymatic activity such as protease or collagenase or protein kinase activity associated with ovarian cancer.

In a preferred embodiment, the therapeutic moiety can also be a cytotoxic agent. In this method, targeting the cytotoxic agent to ovarian cancer tissue or cells, results in a reduction in the number of afflicted cells, thereby reducing symptoms associated with ovarian cancer. Cytotoxic agents are numerous and varied and include, but are not limited to, cytotoxic drugs or toxins or active fragments of such toxins. Suitable toxins and their corresponding fragments include diphtheria A chain, exotoxin A chain, ricin A chain, abrin A chain, curcin, crotin, phenomycin, enomycin and the like. Cytotoxic agents also include radiochemicals made by conjugating radioisotopes to antibodies raised against ovarian cancer proteins, or binding of a radionuclide to a chelating agent that has been covalently attached to the antibody. Targeting the therapeutic moiety to transmembrane ovarian cancer proteins not only serves to increase the local concentration of therapeutic moiety in the ovarian cancer afflicted area, but also serves to reduce deleterious side effects that may be associated with the untargeted therapeutic moiety.

In another preferred embodiment, the ovarian cancer protein against which the antibodies are raised is an intracellular protein. In this case, the antibody may be conjugated to a protein which facilitates entry into the cell. In one case, the antibody enters the cell by endocytosis. In another embodiment, a nucleic acid encoding the antibody is administered to the individual or cell. Moreover, wherein the ovarian cancer protein can be targeted within a cell, e.g., the nucleus, an antibody thereto contains a signal for that target localization, e.g., a nuclear localization signal.

The ovarian cancer antibodies of the invention specifically bind to ovarian cancer proteins. By "specifically bind" herein is meant that the antibodies bind to the protein with a $K_d$ of at least about 0.1 mM, more usually at least about 1 μM, preferably at least about 0.1 μM or better, and most preferably, 0.01 μM or better. Selectivity of binding is also important.

Detection of Ovarian Cancer Sequence for Diagnostic and Therapeutic Applications In one aspect, the RNA expression levels of genes are determined for different cellular states in the ovarian cancer phenotype. Expression levels of genes in normal tissue (e.g., not undergoing ovarian cancer) and in ovarian cancer tissue (and in some cases, for varying severities of ovarian cancer that relate to prognosis, as outlined below, or in non-malignant disease are evaluated to provide expression profiles. An expression profile of a particular cell state or point of development is essentially a "fingerprint" of the state of the cell. While two states may have any particular gene similarly expressed, the evaluation of a number of genes simultaneously allows the generation of a gene expression profile that is reflective of the state of the cell. By comparing expression profiles of cells in different states, information regarding which genes are important (including both up- and down-regulation of genes) in each of these states is obtained. Then, diagnosis may be performed or confirmed to determine whether a tissue sample has the gene expression profile of normal or cancerous tissue. This will provide for molecular diagnosis of related conditions.

"Differential expression," or grammatical equivalents as used herein, refers to qualitative or quantitative differences in the temporal and/or cellular gene expression patterns within and among cells and tissue. Thus, a differentially expressed gene can qualitatively have its expression altered, including an activation or inactivation, in, e.g., normal versus ovarian cancer tissue. Genes may be turned on or turned off in a particular state, relative to another state thus permitting comparison of two or more states. A qualitatively regulated gene will exhibit an expression pattern within a state or cell type which is detectable by standard techniques. Some genes will be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques as outlined below, such as by use of Affymetrix GeneChip™ expression arrays. See, e.g., Lockhart (1996) *Nature Biotechnology* 14:1675–1680. Other techniques include, but are not limited to, quantitative reverse transcriptase PCR, northern analysis, and RNase protection. As outlined above, preferably the change in expression (e.g., up-regulation or down-regulation) is at least about 50%, more preferably at least about 100%, more preferably at least about 150%, more preferably at least about 200%, with from 300 to at least 1000% being especially preferred.

Evaluation may be at the gene transcript, or the protein level. The amount of gene expression may be monitored using nucleic acid probes to the DNA or RNA equivalent of the gene transcript, and the quantification of gene expression levels, or, alternatively, the final gene product itself (protein) can be monitored, e.g., with antibodies to the ovarian cancer protein and standard immunoassays (ELISAs, etc.) or other techniques, including mass spectroscopy assays, 2D gel electrophoresis assays, etc. Proteins corresponding to ovarian cancer genes, e.g., those identified as being important in an ovarian cancer or disease phenotype, can be evaluated in an ovarian disease diagnostic test. In a preferred embodiment, gene expression monitoring is performed simultaneously on a number of genes. Multiple protein expression monitoring can be performed, or on an individual basis.

In this embodiment, the ovarian cancer nucleic acid probes are attached to biochips as outlined herein for the detection and quantification of ovarian cancer sequences in a particular sample. The assays are further described below in the example. PCR techniques can be used to provide greater sensitivity.

In a preferred embodiment nucleic acids encoding the ovarian cancer protein are detected. Although DNA or RNA encoding the ovarian cancer protein may be detected, of particular interest are methods wherein an mRNA encoding an ovarian cancer protein is detected. Probes to detect mRNA can be a nucleotide/deoxynucleotide probe that is complementary to and hybridizes with the mRNA and includes, but is not limited to, oligonucleotides, cDNA or RNA. Probes also should contain a detectable label, as defined herein. In one method the mRNA is detected after immobilizing the nucleic acid to be examined on a solid support such as nylon membranes and hybridizing the probe with the sample. Following washing to remove the non-specifically bound probe, the label is detected. In another method detection of the mRNA is performed in situ. In this method permeabilized cells or tissue samples are contacted with a detectably labeled nucleic acid probe for sufficient time to allow the probe to hybridize with the target mRNA. Following washing to remove the non-specifically bound probe, the label is detected. For example a digoxygenin labeled riboprobe (RNA probe) that is complementary to the mRNA encoding an ovarian cancer protein is detected by binding the digoxygenin with an anti-digoxygenin secondary antibody and developed with nitro blue tetrazolium and 5-bromo-4-chloro-3-indoyl phosphate.

In a preferred embodiment, various proteins from the three classes of proteins as described herein (secreted, transmembrane or intracellular proteins) are used in diagnostic assays. The ovarian cancer proteins, antibodies, nucleic acids, modified proteins and cells containing ovarian cancer sequences are used in diagnostic assays. This can be performed on an individual gene or corresponding polypeptide level. In a preferred embodiment, the expression profiles are used, preferably in conjunction with high throughput screening techniques to allow monitoring for expression profile genes and/or corresponding polypeptides.

As described and defined herein, ovarian cancer proteins, including intracellular, transmembrane, or secreted proteins, find use as prognostic or diagnostic markers of ovarian disease. Detection of these proteins in putative ovarian cancer tissue allows for detection, diagnosis, or prognosis of ovarian disease, and for selection of therapeutic strategy. In one embodiment, antibodies are used to detect ovarian cancer proteins. A preferred method separates proteins from a sample by electrophoresis on a gel (typically a denaturing and reducing protein gel, but may be another type of gel, including isoelectric focusing gels and the like). Following separation of proteins, the ovarian cancer protein is detected, e.g., by immunoblotting with antibodies raised against the ovarian cancer protein. Methods of immunoblotting are well known to those of ordinary skill in the art.

In another preferred method, antibodies to the ovarian cancer protein find use in in situ imaging techniques, e.g., in histology. See, e.g., Asai (ed. 1993) *Methods in Cell Biology: Antibodies in Cell Biology* (vol. 37) Academic Press. Cells are contacted with from one to many antibodies to the ovarian cancer protein(s). Following washing to remove non-specific antibody binding, the presence of the antibody or antibodies is detected. In one embodiment the antibody is detected by incubating with a secondary antibody that contains a detectable label. In another method the primary antibody to the ovarian cancer protein(s) contains a detectable label, e.g., an enzyme marker that can act on a substrate.

In another preferred embodiment each one of multiple primary antibodies contains a distinct and detectable label. This method finds particular use in simultaneous screening for a plurality of ovarian cancer proteins. As will be appreciated by one of ordinary skill in the art, many other histological imaging techniques are also provided by the invention.

In a preferred embodiment the label is detected in a fluorometer which has the ability to detect and distinguish emissions of different wavelengths. In addition, a fluorescence activated cell sorter (FACS) can be used in the method.

In another preferred embodiment, antibodies find use in diagnosing ovarian cancer from blood, serum, plasma, stool, and other samples. Such samples, therefore, are useful as samples to be probed or tested for the presence of ovarian cancer proteins. Antibodies can be used to detect an ovarian cancer protein by previously described immunoassay techniques including ELISA, immunoblotting (western blotting), immunoprecipitation, BIACORE technology, and the like. Conversely, the presence of antibodies may indicate an immune response against an endogenous ovarian cancer protein.

In a preferred embodiment, in situ hybridization of labeled ovarian cancer nucleic acid probes to tissue arrays is done. For example, arrays of tissue samples, including ovarian cancer tissue and/or normal tissue, are made. In situ hybridization (see, e.g., Ausubel, supra) is then performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

In a preferred embodiment, the ovarian cancer proteins, antibodies, nucleic acids, modified proteins and cells containing ovarian cancer sequences are used in prognosis assays. As above, gene expression profiles can be generated that correlate to ovarian cancer, clinical, pathological, or other information, in terms of long term prognosis. Again, this may be done on either a protein or gene level, with the use of a plurality of genes being preferred. As above, ovarian cancer probes may be attached to biochips for the detection and quantification of ovarian cancer sequences in a tissue or patient. The assays proceed as outlined above for diagnosis. PCR method may provide more sensitive and accurate quantification.

Assays for Therapeutic Compounds

In a preferred embodiment members of the proteins, nucleic acids, and antibodies as described herein are used in drug screening assays. The ovarian cancer proteins, antibodies, nucleic acids, modified proteins and cells containing ovarian cancer sequences are used in drug screening assays or by evaluating the effect of drug candidates on a "gene expression profile" or expression profile of polypeptides. In a preferred embodiment, the expression profiles are used, preferably in conjunction with high throughput screening techniques to allow monitoring for expression profile genes after treatment with a candidate agent. See, e.g., Zlokarnik, et al. (1998) *Science* 279:84–88; and Heid (1996) *Genome Res.* 6:986–994.

In a preferred embodiment, the ovarian cancer proteins, antibodies, nucleic acids, modified proteins and cells containing the native or modified ovarian cancer proteins are used in screening assays. That is, the present invention provides novel methods for screening for compositions which modulate the ovarian cancer phenotype or an identified physiological function of an ovarian cancer protein. As above, this can be done on an individual gene level or by evaluating the effect of drug candidates on a "gene expression profile". In a preferred embodiment, the expression profiles are used, preferably in conjunction with high throughput screening techniques to allow monitoring for expression profile genes after treatment with a candidate agent. See, e.g., Zlokarnik, supra.

Having identified the differentially expressed genes herein, a variety of assays may be executed. In a preferred embodiment, assays may be run on an individual gene or protein level. That is, having identified a particular gene as up regulated in ovarian cancer, test compounds can be screened for the ability to modulate gene expression or for binding to the ovarian cancer protein. "Modulation" thus includes both an increase and a decrease in gene expression. The preferred amount of modulation will depend on the original change of the gene expression in normal versus tissue undergoing ovarian cancer, with changes of at least 10%, preferably 50%, more preferably 100–300%, and in some embodiments 300–1000% or greater. Thus, if a gene exhibits a 4-fold increase in ovarian cancer tissue compared to normal tissue, a decrease of about four-fold is often desired; similarly, a 10-fold decrease in ovarian cancer tissue compared to normal tissue often provides a target value of a 10-fold increase in expression to be induced by the test compound.

The amount of gene expression may be monitored using nucleic acid probes and the quantification of gene expression levels, or, alternatively, the gene product itself can be monitored, e.g., through the use of antibodies to the ovarian cancer protein and standard immunoassays. Proteomics and separation techniques may also allow quantification of expression.

In a preferred embodiment, gene expression or protein monitoring of a number of entities, e.g., an expression profile, is monitored simultaneously. Such profiles will typically involve a plurality of those entities described herein.

In this embodiment, the ovarian cancer nucleic acid probes are attached to biochips as outlined herein for the detection and quantification of ovarian cancer sequences in a particular cell. Alternatively, PCR may be used. Thus, a series, e.g., of microtiter plate, may be used with dispensed primers in desired wells. A PCR reaction can then be performed and analyzed for each well.

Expression monitoring can be performed to identify compounds that modify the expression of one or more ovarian cancer-associated sequences, e.g., a polynucleotide sequence set out in Tables 1–20. Generally, in a preferred embodiment, a test modulator is added to the cells prior to analysis. Moreover, screens are also provided to identify agents that modulate ovarian cancer, modulate ovarian cancer proteins, bind to an ovarian cancer protein, or interfere with the binding of an ovarian cancer protein and an antibody or other binding partner.

The term "test compound" or "drug candidate" or "modulator" or grammatical equivalents as used herein describes any molecule, e.g., protein, oligopeptide, small organic molecule, polysaccharide, polynucleotide, etc., to be tested for the capacity to directly or indirectly alter the ovarian cancer phenotype or the expression of an ovarian cancer sequence, e.g., a nucleic acid or protein sequence. In preferred embodiments, modulators alter expression profiles, or expression profile nucleic acids or proteins provided herein. In one embodiment, the modulator suppresses an ovarian cancer phenotype, e.g., to a normal or non-malignant tissue fingerprint. In another embodiment, a modulator induced an ovarian cancer phenotype. Generally, a plurality of assay mixtures are run in parallel with different agent concentrations to obtain a differential response to the various concentrations. Typically, one of these concentrations serves as a negative control, e.g., at zero concentration or below the level of detection.

Drug candidates encompass numerous chemical classes, though typically they are organic molecules, preferably small organic compounds having a molecular weight of more than 100 and less than about 2,500 daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof. Particularly preferred are peptides.

In one aspect, a modulator will neutralize the effect of an ovarian cancer protein. By "neutralize" is meant that activity of a protein is inhibited or blocked and the consequent effect on the cell.

In certain embodiments, combinatorial libraries of potential modulators will be screened for an ability to bind to an ovarian cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

In one preferred embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds" or can themselves be used as potential or actual therapeutics.

A combinatorial chemical library is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (e.g., the number of amino acids in a polypeptide compound). Millions of chemical compounds can be synthesized through such combinatorial mixing of chemical building blocks. See, e.g., Gallop, et al. (1994) *J. Med. Chem.* 37:1233–1251.

Preparation and screening of combinatorial chemical libraries is well known to those of skill in the art. Such combinatorial chemical libraries include, but are not limited to, peptide libraries (see, e.g., U.S. Pat. No. 5,010,175; Furka (1991) *Pept. Prot. Res.* 37:487–493; and Houghton, et al.

(1991) *Nature* 354:84–88), peptoids (PCT Publication No WO 91/19735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs, et al. (1993) *Proc. Nat'l Acad. Sci. USA* 90:6909–913), vinylogous polypeptides (Hagihara, et al. (1992) *J. Amer. Chem. Soc.* 114:6568–570), non-peptidal peptidomimetics with a Beta-D-Glucose scaffolding (Hirschmann, et al. (1992) *J. Amer. Chem. Soc.* 114:9217–218), analogous organic syntheses of small compound libraries (Chen, et al. (1994) *J. Amer. Chem. Soc.* 116:2661–662), oligocarbamates (Cho, et al. (1993) *Science* 261:1303–305), and/or peptidyl phosphonates (Campbell, et al. (1994) *J. Org. Chem.* 59:658-xxx). See, generally, Gordon, et al. (1994) *J. Med. Chem.* 37:1385–401, nucleic acid libraries (see, e.g., Stratagene, Corp.), peptide nucleic acid libraries (see, e.g., U.S. Pat. No .5,539,083), antibody libraries (see, e.g., Vaughn, et al. (1996) *Nature Biotechnology* 14:309–314; and PCT/US96/10287), carbohydrate libraries (see, e.g., Liang, et al. (1996) *Science* 274:1520–1522; and U.S. Pat. No. 5,593,853), and small organic molecule libraries (see, e.g., benzodiazepines, page 33, Baum (Jan. 18, 1993) *C&E News;*isoprenoids, U.S. Pat. No. 5,569,588; thiazolidinones and metathiazanones, U.S. Pat. No. 5,549, 974; pyrrolidines, U.S. Pat. Nos. 5,525,735 and 5,519,134; morpholino compounds, U.S. Pat. No. 5,506,337; benzodiazepines, U.S. Pat. No. 5,288,514; and the like).

Devices for the preparation of combinatorial libraries are commercially available. See, e.g., 357 MPS, 390 MPS, Advanced Chem Tech, Louisville Ky.; Symphony, Rainin, Woburn, Mass.; 433A Applied Biosystems, Foster City, Calif.; 9050 Plus, Millipore, Bedford, Mass.

A number of well known robotic systems have also been developed for solution phase chemistries. These systems include automated workstations like the automated synthesis apparatus developed by Takeda Chemical Industries, LTD. (Osaka, Japan) and many robotic systems utilizing robotic arms (Zymate II, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The assays to identify modulators are amenable to high throughput screening. Preferred assays thus detect enhancement or inhibition of ovarian cancer gene transcription, inhibition or enhancement of polypeptide expression, and inhibition or enhancement of polypeptide activity.

High throughput assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins, U.S. Pat. No. 5,585,639 discloses high throughput screening methods for nucleic acid binding (e.g., in arrays), while U.S. Pat. Nos. 5,576,220 and 5,541,061 disclose high throughput methods of screening for ligand/antibody binding.

In addition, high throughput screening systems are commercially available (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These systems typically automate entire procedures, including all sample and reagent pipetting, liquid dispensing, timed incubations, and final readings of the microplate in detector(s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

In one embodiment, modulators are proteins, often naturally occurring proteins or fragments of naturally occurring proteins. Thus, e.g., cellular extracts containing proteins, or random or directed digests of proteinaceous cellular extracts, may be used. In this way libraries of proteins may be made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes or ligands and receptors.

In a preferred embodiment, modulators are peptides of from about 5 to about 30 amino acids, with from about 5 to about 20 amino acids being preferred, and from about 7 to about 15 being particularly preferred. The peptides may be digests of naturally occurring proteins as is outlined above, random peptides, or "biased" random peptides. By "randomized" or grammatical equivalents herein is meant that each nucleic acid and peptide consists of essentially random nucleotides and amino acids, respectively. Since generally these random peptides (or nucleic acids, discussed below) are chemically synthesized, they may incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, the library is fully randomized, with no sequence preferences or constants at any position. In a preferred embodiment, the library is biased. That is, some positions within the sequence are either held constant, or are selected from a limited number of possibilities. For example, in a preferred embodiment, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

Modulators of ovarian cancer can also be nucleic acids, as defined above.

As described above generally for proteins, nucleic acid modulating agents may be naturally occurring nucleic acids, random nucleic acids, or "biased" random nucleic acids. For example, digests of procaryotic or eucaryotic genomes may be used as is outlined above for proteins.

In a preferred embodiment, the candidate compounds are organic chemical moieties, a wide variety of which are available in the literature.

After the candidate agent has been added and the cells allowed to incubate for some period of time, the sample containing a target sequence to be analyzed is added to the biochip. If required, the target sequence is prepared using known techniques. For example, the sample may be treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

In a preferred embodiment, the target sequence is labeled with, e.g., a fluorescent, a chemiluminescent, a chemical, or a radioactive signal, to provide a means of detecting the target sequence's specific binding to a probe. The label also can be an enzyme, such as, alkaline phosphatase or horseradish peroxidase, which when provided with an appropriate substrate produces a product that can be detected. Alternatively, the label can be a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference. In this embodiment, in general, the target nucleic acid is prepared as outlined above, and then added to the biochip comprising a plurality of nucleic acid probes, under conditions that allow the formation of a hybridization complex.

A variety of hybridization conditions may be used in the present invention, including high, moderate and low stringency conditions as outlined above. The assays are generally run under stringency conditions which allows formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc.

These parameters may also be used to control non-specific binding, as is generally outlined in U.S. Pat. No. 5,681,697. Thus it may be desirable to perform certain steps at higher stringency conditions to reduce non-specific binding.

The reactions outlined herein may be accomplished in a variety of ways. Components of the reaction may be added simultaneously, or sequentially, in different orders, with preferred embodiments outlined below. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors, anti-microbial agents, etc., may also be used as appropriate, depending on the sample preparation methods and purity of the target.

The assay data are analyzed to determine the expression levels, and changes in expression levels as between states, of individual genes, forming a gene expression profile.

Screens are performed to identify modulators of the ovarian cancer phenotype. In one embodiment, screening is performed to identify modulators that can induce or suppress a particular expression profile, thus preferably generating the associated phenotype. In another embodiment, e.g., for diagnostic applications, having identified differentially expressed genes important in a particular state, screens can be performed to identify modulators that alter expression of individual genes. In an another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition screens can be done for genes that are induced in response to a candidate agent. After identifying a modulator based upon its ability to suppress an ovarian cancer expression pattern leading to a normal expression pattern, or to modulate a single ovarian cancer gene expression profile so as to mimic the expression of the gene from normal tissue, a screen as described above can be performed to identify genes that are specifically modulated in response to the agent. Comparing expression profiles between normal tissue and agent treated ovarian cancer tissue reveals genes that are not expressed in normal tissue or ovarian cancer tissue, but are expressed in agent treated tissue. These agent-specific sequences can be identified and used by methods described herein for ovarian cancer genes or proteins. In particular these sequences and the proteins they encode find use in marking or identifying agent treated cells. In addition, antibodies can be raised against the agent induced proteins and used to target novel therapeutics to the treated ovarian cancer tissue sample.

Thus, in one embodiment, a test compound is administered to a population of ovarian cancer cells, that have an associated ovarian cancer expression profile. By "administration" or "contacting" herein is meant that the candidate agent is added to the cells in such a manner as to allow the agent to act upon the cell, whether by uptake and intracellular action, or by action at the cell surface. In some embodiments, nucleic acid encoding a proteinaceous candidate agent (e.g., a peptide) may be put into a viral construct such as an adenoviral or retroviral construct, and added to the cell, such that expression of the peptide agent is accomplished, e.g., PCT US97/01019. Regulatable gene therapy systems can also be used.

Once the test compound has been administered to the cells, the cells can be washed if desired and are allowed to incubate under preferably physiological conditions for some period of time. The cells are then harvested and a new gene expression profile is generated, as outlined herein.

Thus, e.g., ovarian cancer or non-malignant tissue may be screened for agents that modulate, e.g., induce or suppress the ovarian cancer phenotype. A change in at least one gene, preferably many, of the expression profile indicates that the agent has an effect on ovarian cancer activity. By defining such a signature for the ovarian cancer phenotype, screens for new drugs that alter the phenotype can be devised. With this approach, the drug target need not be known and need not be represented in the original expression screening platform, nor does the level of transcript for the target protein need to change.

In a preferred embodiment, as outlined above, screens may be done on individual genes and gene products (proteins). That is, having identified a particular differentially expressed gene as important in a particular state, screening of modulators of either the expression of the gene or the gene product itself can be done. The gene products of differentially expressed genes are sometimes referred to herein as "ovarian cancer proteins" or a "ovarian cancer modulatory protein". The ovarian cancer modulatory protein may be a fragment, or alternatively, be the full length protein to the fragment encoded by the nucleic acids of the Tables. Preferably, the ovarian cancer modulatory protein is a fragment. In a preferred embodiment, the ovarian cancer amino acid sequence which is used to determine sequence identity or similarity is encoded by a nucleic acid of the Tables. In another embodiment, the sequences are naturally occurring allelic variants of a protein encoded by a nucleic acid of the Tables. In another embodiment, the sequences are sequence variants as further described herein.

Preferably, the ovarian cancer modulatory protein is a fragment of approximately 14 to 24 amino acids long. More preferably the fragment is a soluble fragment. Preferably, the fragment includes a non-transmembrane region. In a preferred embodiment, the fragment has an N-terminal Cys to aid in solubility. In another embodiment, the C-terminus of the fragment is kept as a free acid and the N-terminus is a free amine to aid in coupling, e.g., to cysteine. Or, the ovarian cancer proteins are conjugated to an immunogenic agent, e.g., to BSA.

Measurements of ovarian cancer polypeptide activity, or of ovarian cancer or the ovarian cancer phenotype can be performed using a variety of assays. For example, the effects of the test compounds upon the function of the ovarian cancer polypeptides can be measured by examining parameters described above. A suitable physiological change that affects activity can be used to assess the influence of a test compound on the polypeptides of this invention. When the functional consequences are determined using intact cells or animals, one can also measure a variety of effects such as, in the case of ovarian cancer associated with tumors, tumor growth, tumor metastasis, neovascularization, hormone release, transcriptional changes to both known and uncharacterized genetic markers (e.g., northern blots), changes in cell metabolism such as cell growth or pH changes, and changes in intracellular second messengers such as cGMP. In the assays of the invention, mammalian ovarian cancer polypeptide is typically used, e.g., mouse, preferably human.

Assays to identify compounds with modulating activity can be performed in vitro. For example, an ovarian cancer polypeptide is first contacted with a potential modulator and incubated for a suitable amount of time, e.g., from 0.5 to 48 hours. In one embodiment, the ovarian cancer polypeptide levels are determined in vitro by measuring the level of protein or mRNA. The level of protein is measured using immunoassays such as western blotting, ELISA and the like with an antibody that selectively binds to the ovarian cancer polypeptide or a fragment thereof. For measurement of mRNA, amplification, e.g., using PCR, LCR, or hybridization assays, e.g., northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using the ovarian cancer protein promoter operably linked to a reporter gene such as luciferase, green fluorescent protein, CAT, or β-gal. The reporter construct is typically transfected into a cell. After treatment with a potential modulator, the amount of reporter gene transcription, translation, or activity is measured according to standard techniques known to those of skill in the art.

In a preferred embodiment, as outlined above, screens may be done on individual genes and gene products (proteins). That is, having identified a particular differentially expressed gene as important in a particular state, screening of modulators of the expression of the gene or the gene product itself can be done. The gene products of differentially expressed genes are sometimes referred to herein as "ovarian cancer proteins." The ovarian cancer protein may be a fragment, or alternatively, be the full length protein to a fragment shown herein.

In one embodiment, screening for modulators of expression of specific genes is performed. Typically, the expression of only one or a few genes are evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

In a preferred embodiment, binding assays are done. In general, purified or isolated gene product is used; that is, the gene products of one or more differentially expressed nucleic acids are made. For example, antibodies are generated to the protein gene products, and standard immunoassays are run to determine the amount of protein present. Alternatively, cells comprising the ovarian cancer proteins can be used in the assays.

Thus, in a preferred embodiment, the methods comprise combining an ovarian cancer protein and a candidate compound, and determining the binding of the compound to the ovarian cancer protein. Preferred embodiments utilize the human ovarian cancer protein, although other mammalian proteins, e.g., counterparts, may also be used, e.g., for the development of animal models of human disease. In some embodiments, as outlined herein, variant or derivative ovarian cancer proteins may be used.

Generally, in a preferred embodiment of the methods herein, the ovarian cancer protein or the candidate agent is non-diffusably bound to an insoluble support having isolated sample receiving areas (e.g., a microtiter plate, an array, etc.). The insoluble supports may be made of any composition to which the compositions can be bound, is readily separated from soluble material, and is otherwise compatible with the overall method of screening. The surface of such supports may be solid or porous and of any convenient shape. Examples of suitable insoluble supports include microtiter plates, arrays, membranes and beads. These are typically made of glass, plastic (e.g., polystyrene), polysaccharides, nylon or nitrocellulose, teflon™, etc. Microtiter plates and arrays are especially convenient because a large number of assays can be carried out simultaneously, using small amounts of reagents and samples. The particular manner of binding of the composition is not crucial so long as it is compatible with the reagents and overall methods of the invention, maintains the activity of the composition and is non-diffusible. Preferred methods of binding include the use of antibodies (which do not sterically block either the ligand binding site or activation sequence when the protein is bound to the support), direct binding to "sticky" or ionic supports, chemical crosslinking, the synthesis of the protein or agent on the surface, etc. Following binding of the protein or agent, excess unbound material is removed by washing. The sample receiving areas may then be blocked through incubation with bovine serum albumin (BSA), casein or other innocuous protein or other moiety.

In a preferred embodiment, the ovarian cancer protein is bound to the support, and a test compound is added to the assay. Alternatively, the candidate agent is bound to the support and the ovarian cancer protein is added. Novel binding agents include specific antibodies, non-natural binding agents identified in screens of chemical libraries, peptide analogs, etc. Of particular interest are screening assays for agents that have a low toxicity for human cells. A wide variety of assays may be used for this purpose, including labeled in vitro protein-protein binding assays, electrophoretic mobility shift assays, immunoassays for protein binding, functional assays (phosphorylation assays, etc.) and the like.

The determination of the binding of the test modulating compound to the ovarian cancer protein may be done in a number of ways. In a preferred embodiment, the compound is labeled, and binding determined directly, e.g., by attaching all or a portion of the ovarian cancer protein to a solid support, adding a labeled candidate agent (e.g., a fluorescent label), washing off excess reagent, and determining whether the label is present on the solid support. Various blocking and washing steps may be utilized as appropriate.

In some embodiments, only one of the components is labeled, e.g., the proteins (or proteinaceous candidate compounds) can be labeled. Alternatively, more than one component can be labeled with different labels, e.g., $^{125}I$ for the proteins and a fluorophor for the compound. Proximity reagents, e.g., quenching or energy transfer reagents are also useful.

In one embodiment, the binding of the test compound is determined by competitive binding assay. The competitor is a binding moiety known to bind to the target molecule (e.g., an ovarian cancer protein), such as an antibody, peptide, binding partner, ligand, etc. Under certain circumstances, there may be competitive binding between the compound and the binding moiety, with the binding moiety displacing the compound. In one embodiment, the test compound is labeled. Either the compound, or the competitor, or both, is added first to the protein for a time sufficient to allow binding, if present. Incubations may be performed at a temperature which facilitates optimal activity, typically 4–40° C. Incubation periods are typically optimized, e.g., to facilitate rapid high throughput screening. Typically between 0.1 and 1 hr will be sufficient. Excess reagent is generally removed or washed away. The second component is then added, and the presence or absence of the labeled component is followed, to indicate binding.

In a preferred embodiment, the competitor is added first, followed by the test compound. Displacement of the competitor is an indication that the test compound is binding to the ovarian cancer protein and thus is capable of binding to, and potentially modulating, the activity of the ovarian cancer protein. In this embodiment, either component can be labeled. Thus, e.g., if the competitor is labeled, the presence of label in the wash solution indicates displacement by the agent. Alternatively, if the test compound is labeled, the presence of the label on the support indicates displacement.

In an alternative embodiment, the test compound is added first, with incubation and washing, followed by the competitor. The absence of binding by the competitor may indicate that the test compound is bound to the ovarian cancer protein with a higher affinity. Thus, if the test compound is labeled, the presence of the label on the support, coupled with a lack of competitor binding, may indicate that the test compound is capable of binding to the ovarian cancer protein.

In a preferred embodiment, the methods comprise differential screening to identity agents that are capable of modulating the activity of the ovarian cancer proteins. In this embodiment, the methods comprise combining an ovarian cancer protein and a competitor in a first sample. A second sample comprises a test compound, an ovarian cancer protein, and a competitor. The binding of the competitor is determined for both samples, and a change, or difference in binding between the two samples indicates the presence of an agent capable of binding to the ovarian cancer protein and potentially modulating its activity. That is, if the binding of the competitor is different in the second sample relative to the first sample, the agent is capable of binding to the ovarian cancer protein.

Alternatively, differential screening is used to identify drug candidates that bind to the native ovarian cancer protein, but cannot bind to modified ovarian cancer proteins. The structure of the ovarian cancer protein may be modeled, and used in rational drug design to synthesize agents that interact with that site. Drug candidates that affect the activity of an ovarian cancer protein are also identified by screening drugs for the ability to either enhance or reduce the activity of the protein.

Positive controls and negative controls may be used in the assays. Preferably control and test samples are performed in at least triplicate to obtain statistically significant results. Incubation of all samples is for a time sufficient for the binding of the agent to the protein. Following incubation, samples are washed free of non-specifically bound material and the amount of bound, generally labeled agent determined. For example, where a radiolabel is employed, the samples may be counted in a scintillation counter to determine the amount of bound compound.

A variety of other reagents may be included in the screening assays. These include reagents like salts, neutral proteins, e.g., albumin, detergents, etc. which may be used to facilitate optimal protein-protein binding and/or reduce non-specific or background interactions. Also reagents that otherwise improve the efficiency of the assay, such as protease inhibitors, nuclease inhibitors, anti-microbial agents, etc., may be used. The mixture of components may be added in an order that provides for the requisite binding.

In a preferred embodiment, the invention provides methods for screening for a compound capable of modulating the activity of an ovarian cancer protein. The methods comprise adding a test compound, as defined above, to a cell comprising ovarian cancer proteins. Preferred cell types include almost any cell. The cells contain a recombinant nucleic acid that encodes an ovarian cancer protein. In a preferred embodiment, a library of candidate agents are tested on a plurality of cells.

In one aspect, the assays are evaluated in the presence or absence or previous or subsequent exposure of physiological signals, e.g., hormones, antibodies, peptides, antigens, cytokines, growth factors, action potentials, pharmacological agents including chemotherapeutics, radiation, carcinogenics, or other cells (e.g., cell-cell contacts). In another example, the determinations are determined at different stages of the cell cycle process.

In this way, compounds that modulate ovarian cancer agents are identified. Compounds with pharmacological activity are able to enhance or interfere with the activity of the ovarian cancer protein. Once identified, similar structures are evaluated to identify critical structural feature of the compound.

In one embodiment, a method of inhibiting ovarian cancer cell division is provided. The method comprises administration of an ovarian cancer inhibitor. In another embodiment, a method of inhibiting ovarian cancer is provided. The method comprises administration of an ovarian cancer inhibitor. In a further embodiment, methods of treating cells or individuals with ovarian cancer are provided. The method comprises administration of an ovarian cancer inhibitor.

In one embodiment, an ovarian cancer inhibitor is an antibody as discussed above. In another embodiment, the ovarian cancer inhibitor is an antisense or RNAi molecule.

A variety of cell viability, growth, proliferation, and metastasis assays are known to those of skill in the art, as described below.

Soft Agar Growth or Colony Formation in Suspension

Normal cells require a solid substrate to attach and grow. When the cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, regenerate normal phenotype and require a solid substrate to attach and grow. Soft agar growth or colony formation in suspension assays can be used to identify modulators of ovarian cancer sequences, which when expressed in host cells, inhibit abnormal cellular proliferation and transformation. A therapeutic compound would reduce or eliminate the host cells' ability to grow in stirred suspension culture or suspended in semi-solid media, such as semi-solid or soft.

Techniques for soft agar growth or colony formation in suspension assays are described in Freshney (1994) *Culture of Animal Cells: A Manual of Basic Technique* (3d ed.) Wiley-Liss, herein incorporated by reference. See also, the methods section of Garkavtsev, et al. (1996), supra, herein incorporated by reference.

Contact Inhibition and Density Limitation of Growth

Normal cells typically grow in a flat and organized pattern in a petri dish until they touch other cells. When the cells touch one another, they are contact inhibited and stop growing. When cells are transformed, however, the cells are not contact inhibited and continue to grow to high densities in disorganized foci. Thus, the transformed cells grow to a higher saturation density than normal cells. This can be detected morphologically by the formation of a disoriented monolayer of cells or rounded cells in foci within the regular pattern of normal surrounding cells. Alternatively, labeling index with ($^3$H)-thymidine at saturation density can be used to measure density limitation of growth. See, e.g., Freshney (1994), supra. The transformed cells, when transfected with tumor suppressor genes, regenerate a normal phenotype and become contact inhibited and would grow to a lower density.

In this assay, labeling index with ($^3$H)-thymidine at saturation density is a preferred method of measuring density limitation of growth. Transformed host cells are transfected with an ovarian cancer-associated sequence and are grown for 24 hr at saturation density in non-limiting medium conditions. The percentage of cells labeling with ($^3$H)-thymidine is determined autoradiographically. See, e.g., Freshney (1994), supra.

Growth Factor or Serum Dependence

Transformed cells typically have a lower serum dependence than their normal counterparts. See, e.g., Temin (1966) *J. Nat'l Cancer Inst.* 37:167–175; Eagle, et al. (1970) *J. Exp. Med.* 131:836–879; and Freshney, supra. This is in part due to release of various growth factors by the transformed cells. Growth factor or serum dependence of transformed host cells can be compared with that of control.

Tumor Specific Markers Levels

Tumor cells release an increased amount of certain factors (hereinafter "tumor specific markers") than their normal counterparts. For example, plasminogen activator (PA) is released from human glioma at a higher level than from normal brain cells (see, e.g., Gullino, pp. 178–184 "Angiogenesis, tumor vascularization, and potential interference with tumor growth" in Mihich (ed. 1985) *Biological Responses in Cancer* Plenum. Similarly, tumor angiogenesis factor (TAF) is released at a higher level in tumor cells than their normal counterparts. See, e.g., Folkman (1992) *Sem Cancer Biol.* 3:89–96.

Various techniques which measure the release of these factors are described in Freshney (1994), supra. Also, see, Unkeless, et al. (1974) *J. Biol. Chem.* 249:4295–4305; Strickland and Beers (1976) *J. Biol. Chem.* 251:5694–5702; Whur, et al. (1980) *Br. J. Cancer* 42:305–312; Gullino, pp. 178–184 "Angiogenesis, tumor vascularization, and potential interference with tumor growth" in Mihich (ed. 1985) *Biological Responses in Cancer* Plenum; and Freshney (1985) *Anticancer Res.* 5:111–130.

Invasiveness into Matrigel

The degree of invasiveness into Matrigel or some other extracellular matrix constituent can be used as an assay to identify compounds that modulate ovarian cancer-associated sequences. Tumor cells exhibit a good correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells.

Alternatively, the level of invasion of host cells can be measured by using filters coated with Matrigel or some other extracellular matrix constituent. Penetration into the gel, or through to the distal side of the filter, is rated as invasiveness, and rated histologically by number of cells and distance moved, or by pre-labeling the cells with $^{125}$I and counting the radioactivity on the distal side of the filter or bottom of the dish. See, e.g., Freshney (1984), supra.

Tumor Growth in Vivo

Effects of ovarian cancer-associated sequences on cell growth can be tested in transgenic or immune-suppressed mice. Knock-out transgenic mice can be made, in which the ovarian cancer gene is disrupted or in which an ovarian cancer gene is inserted. Knock-out transgenic mice can be made by insertion of a marker gene or other heterologous gene into the endogenous ovarian cancer gene site in the mouse genome via homologous recombination. Such mice can also be made by substituting the endogenous ovarian cancer gene with a mutated version of the ovarian cancer gene, or by mutating the endogenous ovarian cancer gene, e.g., by exposure to carcinogens.

A DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells partially derived from the mutant cell line. By breeding the chimeric mice it is possible to obtain a new line of mice containing the introduced genetic lesion. See, e.g., Capecchi, et al. (1989) *Science* 244:1288–1292. Chimeric targeted mice can be derived according to Hogan, et al. (1988) *Manipulating the Mouse Embryo: A Laboratory Manual* CSH Press; and Robertson (ed. 1987) *Teratocarcinomas and Embryonic Stem Cells: A Practical Approach* IRL Press, Washington, D.C.

Alternatively, various immune-suppressed or immune-deficient host animals can be used. For example, genetically athymic "nude" mouse (see, e.g., Giovanella, et al. (1974) *J. Nat'l Cancer Inst.* 52:921–930), a SCID mouse, a thymectomized mouse, or an irradiated mouse (see, e.g., Bradley, et al. (1978) *Br. J. Cancer* 38:263–272; Selby, et al. (1980) *Br. J. Cancer* 41:52–61) can be used as a host. Transplantable tumor cells (typically about $10^6$ cells) injected into isogenic hosts will produce invasive tumors in a high proportions of cases, while normal cells of similar origin will not. In hosts which developed invasive tumors, cells expressing an ovarian cancer-associated sequences are injected subcutaneously. After a suitable length of time, preferably 4–8 weeks, tumor growth is measured (e.g., by volume or by its two largest dimensions) and compared to the control. Tumors that have statistically significant reduction (using, e.g., Student's T test) are said to have inhibited growth.

Polynucleotide Modulators of Ovarian Cancer

Antisense and RNAi Polynucleotides

In certain embodiments, the activity of an ovarian cancer-associated protein is down-regulated, or entirely inhibited, by the use of antisense polynucleotide, e.g., a nucleic acid complementary to, and which can preferably hybridize specifically to, a coding mRNA nucleic acid sequence, e.g., an ovarian cancer protein mRNA, or a subsequence thereof. Binding of the antisense polynucleotide to the mRNA reduces the translation and/or stability of the mRNA.

In the context of this invention, antisense polynucleotides can comprise naturally-occurring nucleotides, or synthetic species formed from naturally-occurring subunits or their close homologs. Antisense polynucleotides may also have altered sugar moieties or inter-sugar linkages. Exemplary among these are the phosphorothioate and other sulfur containing species which are known for use in the art. Analogs are comprehended by this invention so long as they function effectively to hybridize with the ovarian cancer protein mRNA. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the antisense strand. The antisense and sense oligonucleotide comprise a single-stranded nucleic acid sequence (either RNA or DNA) capable of binding to target mRNA (sense) or DNA (antisense) sequences for ovarian cancer molecules. A preferred antisense molecule is for an ovarian cancer sequences in Tables 1–20, or for a ligand or activator thereof. Antisense or sense oligonucleotides, according to the present invention, comprise a fragment generally at least about 14 nucleotides, preferably from about 14 to 30 nucleotides. An antisense or a sense oligonucleotide can be developed based upon a cDNA sequence encoding a given protein. See, e.g., Stein and Cohen (1988) *Cancer Res.* 48:2659–2668; and van der Krol, et al. (1988) *BioTechniques* 6:958–976.

RNA interference is a mechanism to suppress gene expression in a sequence specific manner. See, e.g., Brumelkamp, et al. (2002) *Sciencexpress* (21 Mar. 2002); Sharp (1999) *Genes Dev.* 13:139–141; and Cathew (2001) *Curr. Op. Cell Biol.* 13:244–248. In mammalian cells, short, e.g., 21 nt, double stranded small interfering RNAs (siRNA) have been shown to be effective at inducing an RNAi response. See, e.g., Elbashir, et al. (2001) *Nature* 411: 494–498. The mechanism may be used to down-regulate expression levels of identified genes, e.g., treatment of or validation of relevance to disease.

Ribozymes

In addition to antisense polynucleotides, ribozymes can be used to target and inhibit transcription of ovarian cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto, et al. (1994) *Adv. Pharmacol.* 25: 289–317 for a general review of the properties of different ribozymes).

The general features of hairpin ribozymes are described, e.g., in Hampel, et al. (1990) *Nucl. Acids Res.* 18:299–304; European Patent Publication No. 0 360 257; U.S. Pat. No. 5,254,678. Methods of preparing them are well known to those of skill in the art. See, e.g., WO 94/26877; Ojwang, et al. (1993) *Proc. Nat'l Acad. Sci. USA* 90:6340–6344; Yamada, et al. (1994) *Hum. Gene Ther.* 1:39–45; Leavitt, et al. (1995) *Proc. Nat'l Acad. Sci. USA* 92:699–703; Leavitt, et al. (1994) *Hum. Gene Ther.* 5:1151–120; and Yamada, et al. (1994) *Virology* 205:121–126.

Polynucleotide modulators of ovarian cancer may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of ovarian cancer may be introduced into a cell containing the target nucleic acid sequence, e.g., by formation of an polynucleotide-lipid complex, as described in WO 90/10448. It is understood that the use of antisense molecules or knock out and knock in models may also be used in screening assays as discussed above, in addition to methods of treatment.

Thus, in one embodiment, methods of modulating ovarian cancer in cells or organisms are provided. In one embodiment, the methods comprise administering to a cell an anti-ovarian cancer antibody that reduces or eliminates the biological activity of an endogenous ovarian cancer protein. Alternatively, the methods comprise administering to a cell or organism a recombinant nucleic acid encoding an ovarian cancer protein. This may be accomplished in any number of ways. In a preferred embodiment, e.g., when the ovarian cancer sequence is down-regulated in ovarian cancer, such state may be reversed by increasing the amount of ovarian cancer gene product in the cell. This can be accomplished, e.g., by over-expressing the endogenous ovarian cancer gene or administering a gene encoding the ovarian cancer sequence, using known gene-therapy techniques, e.g. In a preferred embodiment, the gene therapy techniques include the incorporation of the exogenous gene using enhanced homologous recombination (EHR), e.g., as described in PCT/US93/03868, hereby incorporated by reference in its entirety. Alternatively, e.g., when the ovarian cancer sequence is up-regulated in ovarian cancer, the activity of the endogenous ovarian cancer gene is decreased, e.g., by the administration of an ovarian cancer antisense or RNAi nucleic acid.

In one embodiment, the ovarian cancer proteins of the present invention may be used to generate polyclonal and monoclonal antibodies to ovarian cancer proteins. Similarly, the ovarian cancer proteins can be coupled, using standard technology, to affinity chromatography columns. These columns may then be used to purify ovarian cancer antibodies useful for production, diagnostic, or therapeutic purposes. In a preferred embodiment, the antibodies are generated to epitopes unique to an ovarian cancer protein; that is, the antibodies show little or no cross-reactivity to other proteins. The ovarian cancer antibodies may be coupled to standard affinity chromatography columns and used to purify ovarian cancer proteins. The antibodies may also be used as blocking polypeptides, as outlined above, since they will specifically bind to the ovarian cancer protein.

Methods of Identifying Variant Ovarian Cancer-associated Sequences

Without being bound by theory, expression of various ovarian cancer sequences is correlated with ovarian cancer. Accordingly, disorders based on mutant or variant ovarian cancer genes may be determined. In one embodiment, the invention provides methods for identifying cells containing variant ovarian cancer genes, e.g., determining all or part of the sequence of at least one endogenous ovarian cancer genes in a cell. This may be accomplished using any number of sequencing techniques. In a preferred embodiment, the invention provides methods of identifying the ovarian cancer genotype of an individual, e.g., determining all or part of the sequence of at least one ovarian cancer gene of the individual. This is generally done in at least one tissue of the individual, and may include the evaluation of a number of tissues or different samples of the same tissue. The method may include comparing the sequence of the sequenced ovarian cancer gene to a known ovarian cancer gene, e.g., a wild-type gene.

The sequence of all or part of the ovarian cancer gene can then be compared to the sequence of a known ovarian cancer gene to determine if any differences exist. This can be done using any number of known homology programs, such as Bestfit, etc. In a preferred embodiment, the presence of a difference in the sequence between the ovarian cancer gene of the patient and the known ovarian cancer gene correlates with a disease state or a propensity for a disease state, as outlined herein.

In a preferred embodiment, the ovarian cancer genes are used as probes to determine the number of copies of the ovarian cancer gene in the genome.

In another preferred embodiment, the ovarian cancer genes are used as probes to determine the chromosomal localization of the ovarian cancer genes. Information such as chromosomal localization finds use in providing a diagnosis or prognosis in particular when chromosomal abnormalities such as translocations, and the like are identified in the ovarian cancer gene locus.

Administration of Pharmaceutical and Vaccine Compositions

In one embodiment, a therapeutically effective dose of an ovarian cancer protein or modulator thereof, is administered to a patient. By "therapeutically effective dose" herein is meant a dose that produces effects for which it is administered. The exact dose will depend on the purpose of the treatment, and will be ascertainable by one skilled in the art using known techniques. See, e.g., Ansel, et al. (1999) *Pharmaceutical Dosage Forms and Drug Delivery Systems* Lippincott; Lieberman. (1992) *Pharmaceutical Dosage Forms* (vols. 1–3) Dekker, ISBN 0824770846, 082476918X, 0824712692, 0824716981; Lloyd (1999) *The Art, Science and Technology of Pharmaceutical Compounding* Amer. Pharmaceutical Assn.; and Pickar (1999) *Dosage Calculations* Thomson. Adjustments for ovarian cancer degradation, systemic versus localized delivery, and rate of new protease synthesis, as well as the age, body weight, general health, sex, diet, time of administration, drug interaction, and the severity of the condition may be necessary, and will be ascertainable with routine experimentation by those skilled in the art. U.S. patent application Ser. No. 09/687,576, further discloses the use of compositions and methods of diagnosis and treatment in ovarian cancer is hereby expressly incorporated by reference.

A "patient" for the purposes of the present invention includes both humans and other animals, particularly mammals. Thus the methods are applicable to both human therapy and veterinary applications. In the preferred embodiment the patient is a mammal, preferably a primate, and in the most preferred embodiment the patient is human.

The administration of the ovarian cancer proteins and modulators thereof of the present invention can be done in a variety of ways as discussed above, including, but not limited to, orally, subcutaneously, intravenously, intra-nasally, transdermally, intraperitoneally, intramuscularly, intrapulmonary, vaginally, rectally, or intraocularly. In some instances, e.g., in the treatment of wounds and inflammation, the ovarian cancer proteins and modulators may be directly applied as a solution or spray.

The pharmaceutical compositions of the present invention comprise an ovarian cancer protein in a form suitable for administration to a patient. In the preferred embodiment, the pharmaceutical compositions are in a water soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid, and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non-toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine.

The pharmaceutical compositions may also include one or more of the following: carrier proteins such as serum albumin; buffers; fillers such as microcrystalline cellulose, lactose, corn and other starches; binding agents; sweeteners and other flavoring agents; coloring agents; and polyethylene glycol.

The pharmaceutical compositions can be administered in a variety of unit dosage forms depending upon the method of administration. For example, unit dosage forms suitable for oral administration include, but are not limited to, powder, tablets, pills, capsules, and lozenges. It is recognized that ovarian cancer protein modulators (e.g., antibodies, antisense constructs, ribozymes, small organic molecules, etc.) when administered orally, should be protected from digestion. This is typically accomplished either by complexing the molecule(s) with a composition to render it resistant to acidic and enzymatic hydrolysis, or by packaging the molecule(s) in an appropriately resistant carrier, such as a liposome or a protection barrier. Means of protecting agents from digestion are well known in the art.

The compositions for administration will commonly comprise an ovarian cancer protein modulator dissolved in a pharmaceutically acceptable carrier, preferably an aqueous carrier. A variety of aqueous carriers can be used, e.g., buffered saline and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like in accordance with the particular mode of administration selected and the patient's needs. See, e.g., *Remington's Pharmaceutical Science* (15th ed., 1980) and Hardman and Limbird (eds. 2001) *Goodman and Gillman: The Pharmacological Basis of Therapeutics* (10th ed.) McGraw-Hill. Thus, a typical pharmaceutical composition for intravenous administration would be about 0.1 to 10 mg per patient per day. Dosages from 0.1 up to about 100 mg per patient per day may be used, particularly when the drug is administered to a secluded site and not into the blood stream, such as into a body cavity or into a lumen of an organ. Substantially higher dosages are possible in topical administration. Actual methods for preparing parenterally administrable compositions are readily available.

The compositions containing modulators of ovarian cancer proteins can be administered for therapeutic or prophylactic treatments. In therapeutic applications, compositions are administered to a patient suffering from a disease (e.g., a cancer) in an amount sufficient to cure or at least partially arrest the disease and/or its complications. An amount adequate to accomplish this is defined as a "therapeutically effective dose." Amounts effective for this use will depend upon the severity of the disease and the general state of the patient's health. Single or multiple administrations of the compositions may be administered depending on the dosage and frequency as required and tolerated by the patient. In any event, the composition should provide a sufficient quantity of the agents of this invention to effectively treat the patient. An amount of modulator that is capable of preventing or slowing the development of cancer in a mammal is referred to as a "prophylactically effective dose." The particular dose required for a prophylactic treatment will depend upon the medical condition and history of the mammal, the particular cancer being prevented, as well as other factors such as age, weight, gender, administration route, efficiency, etc. Such prophylactic treatments may be used, e.g., in a mammal who has previously had cancer to prevent a recurrence of the cancer, or in a mammal who is suspected of having a significant likelihood of developing cancer based, e.g., in part, upon gene expression profiles. Vaccine strategies may be used, in either a DNA vaccine form, or protein vaccine.

It will be appreciated that the present ovarian cancer protein-modulating compounds can be administered alone or in combination with additional ovarian cancer modulating compounds or with other therapeutic agent, e.g., other anti-cancer agents or treatments.

In numerous embodiments, one or more nucleic acids, e.g., polynucleotides comprising nucleic acid sequences set forth in Tables 1–20, such as RNAi, antisense polynucleotides or ribozymes, will be introduced into cells, in vitro or in vivo. The present invention provides methods, reagents, vectors, and cells useful for expression of ovarian cancer-associated polypeptides and nucleic acids using in vitro (cell-free), ex vivo or in vivo (cell or organism-based) recombinant expression systems.

The particular procedure used to introduce the nucleic acids into a host cell for expression of a protein or nucleic acid is application specific. Many procedures for introducing foreign nucleotide sequences into host cells may be used. These include the use of calcium phosphate transfection, spheroplasts, electroporation, liposomes, microinjection, plasma vectors, viral vectors and any of the other well known methods for introducing cloned genomic DNA, cDNA, synthetic DNA or other foreign genetic material into a host cell. See, e.g., Berger and Kimmel (1987) *Guide to Molecular Cloning Techniques* from *Methods in Enzymology* (vol. 152) Academic Press; Ausubel, et al. (eds. 1999 and supplements) *Current Protocols* Lippincott; and Sambrook, et al. (2001) *Molecular Cloning: A Laboratory Manual* (3d ed., Vol. 1–3) CSH Press.

In a preferred embodiment, ovarian cancer proteins and modulators are administered as therapeutic agents, and can be formulated as outlined above. Similarly, ovarian cancer genes (including both the full-length sequence, partial sequences, or regulatory sequences of the ovarian cancer coding regions) can be administered in a gene therapy application. These ovarian cancer genes can include antisense applications, either as gene therapy (e.g., for incorporation into the genome) or as antisense compositions, as will be appreciated by those in the art.

Ovarian cancer polypeptides and polynucleotides can also be administered as vaccine compositions to stimulate HTL, CTL, and antibody responses. Such vaccine compositions can include, e.g., lipidated peptides (see, e.g., Vitiello, et al. (1995) *J. Clin. Invest.* 95:341–349), peptide compositions encapsulated in poly(D,L-lactide-co-glycolide, "PLG") microspheres (see, e.g., Eldridge, et al. (1991) *Molec. Immunol.* 28:287–294; Alonso, et al. (1994) *Vaccine* 12:299–306; Jones, et al. (1995) *Vaccine* 13:675–681), peptide compositions contained in immune stimulating complexes (IS-COMS; see, e.g., Takahashi, et al. (1990) *Nature* 344: 873–875; Hu, et al. (1998) *Clin. Exp. Immunol.* 113:235–243), multiple antigen peptide systems (MAPs; see, e.g., Tam (1988) *Proc. Nat'l Acad. Sci. USA* 85:5409–5413; Tam (1996) *J. Immunol. Methods* 196:17–32), peptides formulated as multivalent peptides;

peptides for use in ballistic delivery systems, typically crystallized peptides, viral delivery vectors (Perkus, et al., p. 379, in Kaufmann (ed. 1996) *Concepts in Vaccine Development* de Gruyter; Chakrabarti, et al. (1986) *Nature* 320: 535–537; Hu, et al. (1986) *Nature* 320:537–540; Kieny, et al. (1986) *AIDS Bio/Technology* 4:790–795; Top, et al. (1971) *J. Infect. Dis.* 124:148–154; Chanda, et al. (1990) *Virology* 175:535–547), particles of viral or synthetic origin (see, e.g., Kofler, et al. (1996) *J. Immunol. Methods* 192: 25–35; Eldridge, et al. (1993) *Sem. Hematol.* 30:16–24; Falo, et al. (1995) *Nature Med.* 7:649–653), adjuvants (Warren, et al. (1986) *Ann. Rev. Immunol.* 4:369–388; Gupta, et al. (1993) *Vaccine* 11:293–306), liposomes (Reddy, et al.(1992) *J. Immunol.* 148:1585–1589; Rock (1996) *Immunol. Today* 17:131–137), or, naked or particle absorbed cDNA (Ulmer, et al. (1993) *Science* 259:1745–1749; Robinson, et al. (1993) *Vaccine* 11:957–960; Shiver, et al., p. 423, in Kaufmann (ed. 1996) *Concepts in Vaccine Development* de Gruyter; Cease and Berzofsky (1994) *Ann. Rev. Immunol.* 12:923–989; and Eldridge, et al. (1993) *Sem. Hematol.* 30:16–24). Toxin-targeted delivery technologies, also known as receptor mediated targeting, such as those of Avant Immunotherapeutics, Inc. (Needham, Mass.) may also be used.

Vaccine compositions often include adjuvants. Many adjuvants contain a substance designed to protect the antigen from rapid catabolism, such as aluminum hydroxide or mineral oil, and a stimulator of immune responses, such as lipid A, Bortadella pertussis, or Mycobacterium tuberculosis derived proteins. Certain adjuvants are commercially available as, e.g., Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF, interleukin-2, –7, –12, and other like growth factors, may also be used as adjuvants.

Vaccines can be administered as nucleic acid compositions wherein DNA or RNA encoding one or more of the polypeptides, or a fragment thereof, is administered to a patient. See, e.g., Wolff et. al. (1990) *Science* 247:1465–1468; U.S. Pat. Nos. 5,580,859; 5,589,466; 5,804, 566; 5,739,118; 5,736,524; 5,679,647; and WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, the peptides of the invention can be expressed by viral or bacterial vectors. Examples of expression vectors include attenuated viral hosts, such as vaccinia or fowlpox. This approach involves the use of vaccinia virus, e.g., as a vector to express nucleotide sequences that encode ovarian cancer polypeptides or polypeptide fragments. Upon introduction into a host, the recombinant vaccinia virus expresses the immunogenic peptide, and thereby elicits an immune response. Vaccinia vectors and methods useful in immunization protocols are described in, e.g., U.S. Pat. No. 4,722, 848. Another vector is BCG (Bacille Calmette Guerin). BCG vectors are described in Stover, et al. (1991) *Nature* 351: 456–460. A wide variety of other vectors useful for therapeutic administration or immunization e.g., adeno and adeno-associated virus vectors, retroviral vectors, Salmonella typhi vectors, detoxified anthrax toxin vectors, and the like, will be apparent. See, e.g., Shata, et al. (2000) *Mol. Med. Today* 6:66–71; Shedlock, et al. (2000) *J. Leukoc. Biol.* 68:793–806; and Hipp, et al. (2000) *In Vivo* 14:571–85.

Methods for the use of genes as DNA vaccines are well known, and include placing an ovarian cancer gene or portion of an ovarian cancer gene under the control of a regulatable promoter or a tissue-specific promoter for expression in an ovarian cancer patient. The ovarian cancer gene used for DNA vaccines can encode full-length ovarian cancer proteins, but more preferably encodes portions of the ovarian cancer proteins including peptides derived from the ovarian cancer protein. In one embodiment, a patient is immunized with a DNA vaccine comprising a plurality of nucleotide sequences derived from an ovarian cancer gene. For example, ovarian cancer-associated genes or sequence encoding subfragments of an ovarian cancer protein are introduced into expression vectors and tested for their immunogenicity in the context of Class I MHC and an ability to generate cytotoxic T cell responses. This procedure provides for production of cytotoxic T cell responses against cells which present antigen, including intracellular epitopes.

In a preferred embodiment, the DNA vaccines include a gene encoding an adjuvant molecule with the DNA vaccine. Such adjuvant molecules include cytokines that increase the immunogenic response to the ovarian cancer polypeptide encoded by the DNA vaccine. Additional or alternative adjuvants are available.

In another preferred embodiment ovarian cancer genes find use in generating animal models of ovarian cancer. When the ovarian cancer gene identified is repressed or diminished in cancer tissue, gene therapy technology, e.g., wherein antisense RNA directed to the ovarian cancer gene will also diminish or repress expression of the gene. Animal models of ovarian cancer find use in screening for modulators of an ovarian cancer-associated sequence or modulators of ovarian cancer. Similarly, transgenic animal technology including gene knockout technology, e.g., as a result of homologous recombination with an appropriate gene targeting vector, will result in the absence or increased expression of the ovarian cancer protein. When desired, tissue-specific expression or knockout of the ovarian cancer protein may be necessary.

It is also possible that the ovarian cancer protein is overexpressed in ovarian cancer. As such, transgenic animals can be generated that overexpress the ovarian cancer protein. Depending on the desired expression level, promoters of various strengths can be employed to express the transgene. Also, the number of copies of the integrated transgene can be determined and compared for a determination of the expression level of the transgene. Animals generated by such methods find use as animal models of ovarian cancer and are additionally useful in screening for modulators to treat ovarian cancer.

Kits for Use in Diagnostic and/or Prognostic Applications

For use in diagnostic, research, and therapeutic applications suggested above, kits are also provided by the invention. In the diagnostic and research applications such kits may include any or all of the following: assay reagents, buffers, ovarian cancer-specific nucleic acids or antibodies, hybridization probes and/or primers, siRNA or antisense polynucleotides, ribozymes, dominant negative ovarian cancer polypeptides or polynucleotides, small molecules inhibitors of ovarian cancer-associated sequences etc. A therapeutic product may include sterile saline or another pharmaceutically acceptable emulsion and suspension base.

In addition, the kits may include instructional materials containing directions (e.g., protocols) for the practice of the methods of this invention. While the instructional materials typically comprise written or printed materials they are not limited to such. Any medium capable of storing such instructions and communicating them to an end user is contemplated by this invention. Such media include, but are not limited to electronic storage media (e.g., magnetic discs, tapes, cartridges, chips), optical media (e.g., CD ROM), and the like. Such media may include addresses to internet sites that provide such instructional materials.

The present invention also provides for kits for screening for modulators of ovarian cancer-associated sequences. Such kits can be prepared from readily available materials and reagents. For example, such kits can comprise one or more of the following materials: an ovarian cancer-associated polypeptide or polynucleotide, reaction tubes, and instructions for testing ovarian cancer-associated activity. Optionally, the kit contains biologically active ovarian cancer protein. A wide variety of kits and components can be prepared according to the present invention, depending upon the intended user of the kit and the particular needs of the user. Diagnosis would typically involve evaluation of a plurality of genes or products. The genes will be selected based on correlations with important parameters in disease which may be identified in historical or outcome data.

EXAMPLES

Example 1

Gene Chip Analysis

Molecular profiles of various normal and cancerous tissues were determined and analyzed using gene chips. RNA was isolated and gene chip analysis was performed as described (Glynne, et al. (2000) *Nature* 403:672–676; Zhao, et al. (2000) *Genes Dev.* 14:981–993).

TABLE 1A lists about 1119 genes up-regulated in ovarian cancer compared to normal adult tissues. These were selected from 59000 probesets on the Affymetrix/Eos Hu03 GeneChip array such that the ratio of "average" ovarian cancer to "average" normal adult tissues was greater than or equal to 5.0. The "average" ovarian cancer level was set to the second-highest value amongst five ovarian cancers. The "average" normal adult tissue level was set to the 85th percentile amongst various non-malignant tissues.

TABLE 1A

ABOUT 1119 UP-REGULATED OVARIAN CANCER GENES

| Pkey | Ex Accn No | UG ID | Title | ratio |
|---|---|---|---|---|
| 423634 | AW959908 | Hs. 1690 | heparin-binding growth factor binding protein | 65.7 |
| 423017 | AW178761 | Hs. 227948 | "serine (or cysteine) proteinase inhibitor, clade B(ovalbumi | 63.6 |
| 432938 | T27013 | Hs. 3132 | steroidogenic acute regulatory protein | 58.3 |
| 445810 | AW265700 | Hs. 155660 | ESTs | 35.9 |
| 431938 | AA938471 | Hs. 115242 | developmentally regulated GTP-binding protein 1 | 32.0 |
| 407112 | AA070801 | Hs. 51615 | "ESTs, Weakly similar to ALU7_HUMAN ALU SUBFAM | 31.3 |
| 425650 | NM_001944 | Hs. 1925 | desmoglein 3 (pemphigus vulgaris antigen) | 30.0 |
| 402075 | | | predicted exon | 27.9 |
| 400301 | X03635 | Hs. 1657 | estrogen receptor 1 | 26.4 |
| 402639 | | | predicted exon | 25.3 |
| 421948 | L42583 | Hs. 111758 | keratin 6A | 24.7 |
| 414540 | BE379050 | | "gb: 601236655F1 NIH_MGC_44 *Homo sapiens* cDNA clon | 24.6 |
| 418994 | AA296520 | Hs. 89546 | selectin E (endothelial adhesion molecule 1) | 24.5 |
| 401575 | | | predicted exon | 23.6 |
| 457024 | AA397546 | Hs. 119151 | ESTs | 23.2 |
| 440684 | AI253123 | Hs. 127356 | "ESTs, Highly similar to NEST_HUMAN NESTI [H. sapien | 23.1 |
| 459006 | AW298631 | Hs. 27721 | hypothetical protein FLJ20353 | 22.8 |
| 400964 | | | predicted exon | 22.5 |
| 402421 | | | predicted exon | 20.9 |
| 437329 | AA811977 | Hs. 291761 | ESTs | 20.8 |
| 414605 | BE390440 | | "gb: 601283601F1 NIH_MGC_44 *Homo sapiens* cDNA clon | 20.7 |
| 411004 | AW813242 | | "gb: MR3-ST0191-020200-207-g10 ST0191 *Homo sapiens* | 20.4 |
| 401283 | | | predicted exon | 20.3 |
| 440633 | AI140686 | Hs. 263320 | ESTs | 19.9 |
| 445603 | H08345 | Hs. 106234 | ESTs | 19.7 |
| 403786 | | | predicted exon | 19.7 |
| 436508 | AW604381 | Hs. 121121 | ESTs | 19.6 |
| 459390 | BE385725 | | "gb: 601276347F1 NIH_MGC_20 *Homo sapiens* cDNA clon | 19.2 |
| 421823 | N40850 | Hs. 28625 | ESTs | 19.0 |
| 417366 | BE185289 | Hs. 1076 | small proline-rich protein 1B (cornifin) | 18.9 |
| 422525 | AA758797 | Hs. 192807 | ESTs | 18.5 |
| 458121 | S42416 | Hs. 74647 | Human T-cell receptor active alpha-chain mRNA from JM c | 18.3 |
| 430520 | NM_016190 | Hs. 242057 | chromosome 1 open reading frame 10 | 18.1 |
| 450192 | AA263143 | Hs. 24596 | RAD51-interacting protein | 18.0 |
| 416839 | H94900 | Hs. 17882 | ESTs | 17.9 |
| 440788 | AI806594 | Hs. 128577 | ESTs | 17.9 |
| 451072 | AA013451 | Hs. 117929 | ESTs | 17.7 |
| 402203 | | | predicted exon | 17.3 |
| 417611 | AW993983 | | "gb: RC1-BN0035-130400-013-a04 BN0035 *Homo sapiens* | 17.3 |
| 438658 | AI222068 | Hs. 123571 | ESTs | 17.3 |
| 403747 | | | predicted exon | 17.2 |
| 444958 | AW292643 | Hs. 167047 | ESTs | 17.2 |
| 404097 | | | predicted exon | 17.1 |
| 459375 | BE251770 | | "gb: 601112470F1 NIH_MGC_16 *Homo sapiens* cDNA clon | 16.9 |

TABLE 1A-continued

ABOUT 1119 UP-REGULATED OVARIAN CANCER GENES

| Pkey | Ex Accn No | UG ID | Title | ratio |
|---|---|---|---|---|
| 443198 | AI039813 | | gb: ox49d06.x1 Soares_total_fetus_Nb2HF8_9w Homo sapi | 16.9 |
| 441557 | AW452647 | Hs. 270482 | ESTs | 16.9 |
| 433871 | W02410 | Hs. 205555 | ESTs | 16.8 |
| 429163 | AA884766 | | gb: am20a10.s1 Soares_NFL_T_GBC_S1 Homo sapiens cD | 16.7 |
| 443406 | AI056238 | Hs. 143316 | ESTs | 16.7 |
| 400613 | | | predicted exon | 16.6 |
| 448372 | AW445166 | Hs. 170802 | ESTs | 16.5 |
| 410929 | H47233 | Hs. 30643 | ESTs | 16.5 |
| 445887 | AI263105 | Hs. 145597 | ESTs | 16.1 |
| 422036 | AA302647 | Hs. 271891 | ESTs | 16.0 |
| 404767 | | | predicted exon | 15.9 |
| 420831 | AA280824 | Hs. 190035 | ESTs | 15.8 |
| 405196 | | | predicted exon | 15.8 |
| 452947 | AW130413 | | "gb: xf50f04.x1 NCI_CGAP_Gas4 Homo sapiens cDNA clo | 15.8 |
| 429538 | BE182592 | Hs. 139322 | small proline-rich protein 3 | 15.8 |
| 435313 | AI769400 | Hs. 189729 | ESTs | 15.7 |
| 449635 | AI989942 | Hs. 232150 | ESTs | 15.6 |
| 424098 | AF077374 | Hs. 139322 | small proline-rich protein 3 | 15.4 |
| 411660 | AW855718 | | "gb: RC1-CT0279-070100-021-a06 CT0279 Homo sapiens c | 15.4 |
| 442653 | BE269247 | Hs. 170226 | Homo sapiens clone 23579 mRNA sequence | 15.4 |
| 443534 | AI076123 | | gb: oy92e04.x1 Soares_fetal_liver_spleen_1NFLS_S1 Homo | 15.4 |
| 458012 | AI424899 | Hs. 188211 | ESTs | 15.3 |
| 441018 | AI809587 | Hs. 148782 | ESTs | 15.1 |
| 425972 | BE391563 | Hs. 165433 | "ESTs, Highly similar to T17342 hypothetical protein DKFZ | 15.1 |
| 418092 | R45154 | Hs. 106604 | ESTs | 15.1 |
| 410909 | AW898161 | Hs. 53112 | "ESTs, Weakly similar to ALU8_HUMAN ALU SUBFAM | 15.1 |
| 458234 | BE551408 | Hs. 127196 | ESTs | 15.0 |
| 434208 | T92641 | Hs. 127648 | hypothetical protein PRO2176 | 15.0 |
| 403177 | | | predicted exon | 15.0 |
| 423725 | AJ403108 | Hs. 132127 | hypothetical protein LOC57822 | 14.9 |
| 425090 | AA350552 | | "gb: EST57886 Infant brain Homo sapiens cDNA 5' end, mR | 14.7 |
| 409723 | AW885757 | Hs. 257862 | ESTs | 14.6 |
| 423735 | AA330259 | | "gb: EST33963 Embryo, 12 week II Homo sapiens cDNA 5' | 14.6 |
| 444266 | AI424984 | Hs. 125465 | ESTs | 14.5 |
| 443341 | AW631480 | Hs. 8688 | ESTs | 14.4 |
| 457336 | AW969657 | Hs. 291029 | ESTs | 14.4 |
| 440500 | AA972165 | Hs. 150308 | ESTs | 14.4 |
| 446292 | AF081497 | Hs. 279682 | Rh type C glycoprotein | 14.3 |
| 438086 | AA336519 | Hs. 301167 | "Homo sapiens cDNA FLJ21545 fis, clone COL06195" | 14.3 |
| 434715 | BE005346 | Hs. 116410 | ESTs | 14.2 |
| 409387 | AW384900 | Hs. 123526 | ESTs | 14.2 |
| 409272 | AB014569 | Hs. 52526 | KIAA0669 gene product | 14.2 |
| 454913 | AW841462 | | "gb: RC6-CN0014-080300-012-B09 CN0014 Homo sapiens | 14.0 |
| 439846 | T63959 | Hs. 228320 | "Homo sapiens cDNA FLJ23537 fis, clone LNG07690" | 14.0 |
| 409695 | AA296961 | | "gb: EST112514 Adrenal gland tumor Homo sapiens cDNA | 13.9 |
| 422897 | AA679784 | Hs. 4290 | ESTs | 13.9 |
| 404664 | | | predicted exon | 13.9 |
| 458829 | AI557388 | | "gb: PT2_1_6_G03 r tumor2 Homo sapiens cDNA 3', mRNA | 13.8 |
| 407327 | AA487182 | Hs. 269414 | ESTs | 13.8 |
| 455435 | AW939445 | | "gb: QV1-DT0072-310100-056-b07 DT0072 Homo sapiens | 13.7 |
| 449327 | AI638743 | Hs. 224672 | ESTs | 13.7 |
| 411693 | AW857271 | | "gb: CM0-CT0307-210100-158-g09 CT0307 Homo sapiens | 13.7 |
| 407463 | AJ272034 | | "gb: Homo sapiens mRNA for putative capacitative calcium c | 13.6 |
| 446767 | AI380107 | Hs. 158954 | ESTs | 13.6 |
| 433040 | H70423 | Hs. 300511 | ESTs | 13.5 |
| 435209 | AW027809 | Hs. 187698 | "ESTs, Highly similar to cytomegalovirus partial fusion rece | 13.5 |
| 441459 | AI919142 | Hs. 214233 | ESTs | 13.5 |
| 401269 | | | predicted exon | 13.4 |
| 438663 | AI199575 | Hs. 153070 | ESTs | 13.4 |
| 426698 | AA394104 | Hs. 97489 | ESTs | 13.4 |
| 423637 | AL137279 | Hs. 130187 | Homo sapiens mRNA, cDNA DKFZp434O1214 (from clon | 13.2 |
| 448543 | AW897741 | Hs. 21380 | Homo sapiens mRNA; cDNA DKFZp586P1124 (from clon | 13.2 |
| 456714 | AW897265 | | "gb: CM0-NN0057-150400-335-a04 NN0057 Homo sapiens | 13.2 |
| 458356 | AI024855 | Hs. 131575 | ESTs | 13.2 |
| 431822 | AA516049 | | "gb: ng65d01.s1 NCI_CGAP_Lip2 Homo sapiens cDNA clo | 13.1 |
| 454822 | AW833793 | | "gb: QV4-TT0008-130100-080-a06 TT0008 Homo sapiens c | 13.1 |
| 453358 | AI990738 | Hs. 240066 | ESTs | 13.1 |
| 435542 | AA687376 | Hs. 269533 | ESTs | 13.1 |
| 421286 | AA806584 | Hs. 187895 | ESTs | 13.0 |
| 452799 | AI948829 | Hs. 213786 | ESTs | 13.0 |
| 444355 | BE383686 | Hs. 191621 | ESTs | 13.0 |
| 444271 | AW452569 | Hs. 149804 | ESTs | 12.9 |
| 443860 | AW866632 | | "gb: QV4-SN0024-210400-181-g04 SN0024 Homo sapiens | 12.9 |
| 428719 | AA358193 | Hs. 193128 | hypothetical protein FLJ10805 | 12.9 |
| 418282 | AA215535 | Hs. 98133 | ESTs | 12.8 |

TABLE 1A-continued

ABOUT 1119 UP-REGULATED OVARIAN CANCER GENES

| Pkey | Ex Accn No | UG ID | Title | ratio |
|---|---|---|---|---|
| 437308 | AA749417 | Hs. 292353 | ESTs | 12.7 |
| 400584 | | | predicted exon | 12.7 |
| 426306 | AA447310 | Hs. 164059 | "Homo sapiens cDNA FLJ13338 fis, clone OVARC100188 | 12.7 |
| 448466 | AI522109 | Hs. 171066 | ESTs | 12.7 |
| 402738 | | | predicted exon | 12.7 |
| 451531 | AA018311 | Hs. 114762 | ESTs | 12.6 |
| 435243 | AW292886 | Hs. 261373 | adenosine A2b receptor pseudogene | 12.6 |
| 431725 | X65724 | Hs. 2839 | Norrie disease (pseudoglioma) | 12.6 |
| 425108 | AI000489 | Hs. 96967 | ESTs | 12.5 |
| 422330 | D30783 | Hs. 115263 | epiregulin | 12.5 |
| 432949 | AA570749 | Hs. 298866 | ESTs | 12.5 |
| 417009 | AA191719 | Hs. 171872 | DEAD/H (Asp-Glu-Ala-Asp/His) box polypeptide 8 (RNA | 12.4 |
| 456378 | AA843387 | Hs. 87279 | ESTs | 12.4 |
| 432966 | AA650114 | | "gb: ns92h09.s1 NCI_CGAP_Pr3 Homo sapiens cDNA clon | 12.4 |
| 440571 | AA904461 | Hs. 130798 | ESTs | 12.3 |
| 411178 | AW820852 | | "gb: RC2-ST0301-120200-011-f12 ST0301 Homo sapiens c | 12.3 |
| 445934 | AF131737 | Hs. 13475 | hypothetical protein | 12.3 |
| 433917 | AI809325 | Hs. 122814 | Human DNA sequence from clone RP5-1028D15 on chrom | 12.2 |
| 402018 | | | predicted exon | 12.2 |
| 424101 | AA335394 | | "gb: EST39787 Epididymus Homo sapiens cDNA 5' end, mR | 12.2 |
| 448533 | AL119710 | Hs. 21365 | nucleosome assembly protein 1-like 3 | 12.1 |
| 458154 | AW816379 | | "gb: QV4-ST0234-181199-035-g01 ST0234 Homo sapiens c | 12.1 |
| 440919 | AW291274 | Hs. 262826 | ESTs | 12.0 |
| 415747 | AA381209 | | "gb: EST94257 Activated T-cells I Homo sapiens cDNA 5' e | 12.0 |
| 411748 | AW859920 | | "gb: QV1-CT0364-260100-052-g05 CT0364 Homo sapiens | 12.0 |
| 452975 | M85521 | Hs. 69469 | dendritic cell protein | 12.0 |
| 427276 | AA400269 | Hs. 49598 | ESTs | 12.0 |
| 454315 | AW373564 | Hs. 251928 | nuclear pore complex interacting protein | 12.0 |
| 450786 | H86632 | Hs. 33654 | ESTs | 12.0 |
| 402578 | | | predicted exon | 11.9 |
| 459591 | AL037185 | | gb: DKFZp564A1169_r1 564 (synonym hfbr2) Homo sapie | 11.9 |
| 433449 | AW772282 | | "gb: hn71b05.x1 NCI_CGAP_Kid11 Homo sapiens cDNA c | 11.9 |
| 429108 | AA890521 | Hs. 126035 | ESTs | 11.8 |
| 454556 | AW807073 | | "gb: MR4-ST0062-031199-018-d06 ST0062 Homo sapiens | 11.7 |
| 443613 | AI079356 | | gb: oz39b09.s1 Soares_NhHMPu_S1 Homo sapiens cDNA c | 11.7 |
| 400385 | NM_020389 | Hs. 283104 | putative capacitative calcium channel | 11.6 |
| 411725 | AW858396 | | "gb: CM0-CT0341-181299-130-c06 CT0341 Homo sapiens | 11.5 |
| 455174 | AI694575 | Hs. 147801 | ESTs | 11.5 |
| 412402 | AW984788 | | "gb: RC1-HN0015-120400-021-c07 HN0015 Homo sapiens | 11.5 |
| 434205 | AF119861 | Hs. 283032 | hypothetical protein PRO2015 | 11.5 |
| 450496 | AW449251 | Hs. 257131 | ESTs | 11.5 |
| 411149 | N68715 | Hs. 269128 | ESTs | 11.5 |
| 414210 | BE383592 | | "gb: 601297871F1 NIH_MGC_19 Homo sapiens cDNA clon | 11.4 |
| 409994 | D86864 | Hs. 57735 | acetyl LDL receptor; SREC | 11.3 |
| 453845 | AL157568 | | gb: DKFZp761F0816_r1 761 (synonym hamy2) Homo sapi | 11.3 |
| 404849 | | | predicted exon | 11.3 |
| 442824 | BE178065 | Hs. 144081 | ESTs | 11.3 |
| 428548 | AA430058 | Hs. 98649 | EST | 11.3 |
| 434804 | AA649530 | | "gb: ns44f05.s1 NCI_CGAP_Alv1 Homo sapiens cDNA clo | 11.3 |
| 430486 | BE062109 | Hs. 241551 | "chloride channel, calcium activated, family member 2" | 11.3 |
| 400174 | | | predicted exon | 11.2 |
| 424324 | AA346316 | | "gb: EST52440 Greater omentum tumor Homo sapiens cDN | 11.2 |
| 447724 | AW298375 | Hs. 24477 | ESTs | 11.2 |
| 457028 | AW449838 | Hs. 97562 | ESTs | 11.2 |
| 429900 | AA460421 | Hs. 30875 | ESTs | 11.2 |
| 452240 | AI591147 | Hs. 61232 | ESTs | 11.2 |
| 458067 | AA393603 | Hs. 36752 | "Homo sapiens cDNA FLJ22834 fis, clone KAIA4314" | 11.1 |
| 402222 | | | predicted exon | 11.1 |
| 446745 | AW118189 | Hs. 156400 | ESTs | 11.1 |
| 453060 | AW294092 | Hs. 21594 | ESTs | 11.1 |
| 443482 | AW188093 | Hs. 250385 | ESTs | 11.1 |
| 436843 | AA824588 | | "gb: oc83d02.s1 NCI_CGAP_GCB1 Homo sapiens cDNA c | 11.0 |
| 416320 | H47867 | Hs. 34024 | ESTs | 11.0 |
| 435772 | AA700019 | Hs. 132992 | "ATP-binding cassette, sub-family G (WHITE), member 5 ( | 11.0 |
| 451542 | AA018365 | Hs. 32713 | ESTs | 11.0 |
| 408522 | AI541214 | Hs. 46320 | "Small proline-rich protein SPRK [human, odontogenic kera | 11.0 |
| 414712 | N88858.comp | Hs. 77039 | ribosomal protein S3A | 10.9 |
| 411940 | AW876686 | | "gb: CM4-PT0031-180200-507-e05 PT0031 Homo sapiens c | 10.9 |
| 408733 | AW264812 | Hs. 254290 | ESTs | 10.9 |
| 452030 | AL137578 | Hs. 27607 | Homo sapiens mRNA; cDNA DKFZp564N2464 (from clon | 10.9 |
| 458175 | AW296024 | Hs. 150434 | ESTs | 10.9 |
| 400612 | | | predicted exon | 10.9 |
| 440159 | AI637599 | Hs. 126127 | ESTs | 10.8 |
| 429443 | AB028967 | Hs. 202687 | "potassium voltage-gated channel, Shal-related subfamily, m | 10.8 |
| 416319 | AI815601 | Hs. 79197 | "CD83 antigen (activated B lymphocytes, immunoglobulin s | 10.8 |

TABLE 1A-continued

ABOUT 1119 UP-REGULATED OVARIAN CANCER GENES

| Pkey | Ex Accn No | UG ID | Title | ratio |
|---|---|---|---|---|
| 405783 | | | predicted exon | 10.7 |
| 405708 | | | predicted exon | 10.7 |
| 433266 | AI863224 | Hs. 288677 | "Homo sapiens cDNA FLJ13872 fis, clone THYRO100132 | 10.6 |
| 456900 | AA355442 | Hs. 169054 | ESTs | 10.6 |
| 432408 | N39127 | Hs. 76391 | "myxovirus (influenza) resistance 1, homolog of murine (int | 10.6 |
| 451702 | AW665452 | Hs. 246503 | ESTs | 10.6 |
| 418179 | X51630 | Hs. 1145 | Wilms tumor 1 | 10.6 |
| 408987 | H85615 | | gb: yt03f11.r1 Soares retina N2b5HR Homo sapiens cDNA | 10.6 |
| 405285 | | | predicted exon | 10.5 |
| 419276 | BE165909 | Hs. 134682 | "Homo sapiens cDNA FLJ23161 fis, clone LNG09730" | 10.5 |
| 407287 | AI678812 | Hs. 201658 | "ESTs, Weakly similar to ALU4_HUMAN ALU SUBFAM | 10.5 |
| 403065 | | | predicted exon | 10.5 |
| 414195 | BE263293 | | "gb: 601144881F2 NIH_MGC_19 Homo sapiens cDNA clon | 10.4 |
| 454258 | AI457286 | Hs. 143979 | "ESTs, Weakly similar to KIAA1276 protein [H. sapiens]" | 10.4 |
| 412951 | BE018611 | Hs. 251946 | "Homo sapiens cDNA FLJ23107 fis, clone LNG07738" | 10.4 |
| 428888 | AA437010 | Hs. 266584 | ESTs | 10.4 |
| 440834 | AA907027 | Hs. 128606 | ESTs | 10.4 |
| 437096 | AA744406 | | "gb: ny51h02.s1 NCI_CGAP_Pr18 Homo sapiens cDNA clo | 10.4 |
| 400135 | | | predicted exon | 10.4 |
| 447849 | AI538147 | Hs. 164277 | ESTs | 10.3 |
| 400593 | | | predicted exon | 10.3 |
| 427469 | AA403084 | Hs. 269347 | ESTs | 10.3 |
| 402794 | | | predicted exon | 10.2 |
| 452743 | AW965082 | Hs. 61455 | ESTs | 10.2 |
| 448983 | AI611654 | Hs. 224908 | ESTs | 10.2 |
| 422696 | AF242524 | Hs. 26323 | hypothetical nuclear factor SBBI22 | 10.2 |
| 428949 | AA442153 | Hs. 104744 | "ESTs, Weakly similar to AF208855_1 BM-013 [H. sapiens] | 10.2 |
| 409191 | AW818390 | | "gb: RC1-ST0278-160200-014-d10 ST0278 Homo sapiens c | 10.2 |
| 428493 | AK001745 | Hs. 184628 | hypothetical protein FLJ10883 | 10.2 |
| 406076 | AL390179 | Hs. 137011 | Homo sapiens mRNA: cDNA DKFZp547P134 (from clone | 10.2 |
| 410626 | BE407727 | | "gb: 601299771F1 NIH_MGC_21 Homo sapiens cDNA clon | 10.1 |
| 445835 | AW290999 | Hs. 145534 | chromosome 21 open reading frame 23 | 10.1 |
| 452507 | AI904646 | | "gb: QV-BT065-020399-103 BT065 Homo sapiens cDNA, m | 10.1 |
| 433297 | AV658581 | Hs. 282633 | ESTs | 10.1 |
| 426724 | AA383623 | Hs. 293616 | ESTs | 10.0 |
| 436659 | AI217900 | Hs. 144464 | ESTs | 10.0 |
| 405675 | | | predicted exon | 10.0 |
| 413466 | BE141737 | Hs. 254105 | "enolase 1, (alpha)" | 10.0 |
| 447198 | D61523 | Hs. 283435 | ESTs | 10.0 |
| 403306 | NM_006825 | Hs. 74368 | "transmembrane protein (63 kD), endoplasmic reticulum/Go | 10.0 |
| 413544 | BE147225 | | "gb: PM2-HT0225-031299-003-f11 HT0225 Homo sapiens | 9.9 |
| 437094 | AW103746 | Hs. 136907 | ESTs | 9.9 |
| 401497 | | | predicted exon | 9.9 |
| 416203 | H27794 | Hs. 269055 | ESTs | 9.9 |
| 426882 | AA393108 | Hs. 97365 | ESTs | 9.9 |
| 454874 | AW836407 | | "gb: PM3-LT0031-301299-002-b09 LT0031 Homo sapiens | 9.9 |
| 406702 | Z20656 | Hs. 278432 | "myosin, heavy polypeptide 6, cardiac muscle, alpha (cardio | 9.9 |
| 404952 | | | predicted exon | 9.9 |
| 430691 | C14187 | Hs. 103538 | ESTs | 9.9 |
| 444518 | AI160278 | Hs. 146884 | ESTs | 9.8 |
| 416665 | H72974 | | gb: yu28a10.s1 Soares fetal liver spleen 1NFLS Homo sapie | 9.8 |
| 438691 | AA906288 | Hs. 212184 | ESTs | 9.8 |
| 405636 | | | predicted exon | 9.8 |
| 437242 | AA747538 | Hs. 187942 | ESTs | 9.8 |
| 425627 | AF019612 | Hs. 297007 | ESTs | 9.8 |
| 452226 | AA024898 | Hs. 296002 | ESTs | 9.8 |
| 418986 | AI123555 | Hs. 81796 | ESTs | 9.8 |
| 441139 | AW449009 | Hs. 126647 | ESTs | 9.7 |
| 427244 | AA402400 | Hs. 178045 | ESTs | 9.7 |
| 423756 | AA828125 | | "gb: od71a09 s1 NCI_CGAP_Ov2 Homo sapiens cDNA clo | 9.7 |
| 457940 | AL360159 | Hs. 30445 | Homo sapiens mRNA full length insert cDNA close EURO | 9.6 |
| 443526 | AW792804 | Hs. 134002 | ESTs | 9.6 |
| 440576 | AW449775 | Hs. 126008 | ESTs | 9.6 |
| 419088 | AI538323 | Hs. 77496 | small nuclear ribonucleoprotein polypeptide G | 9.6 |
| 454707 | AW814989 | | "gb: MR1-ST0206-170400-024-g05 ST0206 Homo sapiens | 9.6 |
| 446252 | AI283125 | Hs. 150009 | ESTs | 9.6 |
| 434374 | AA631439 | | "gb: np85d02.s1 NCI_CGAP_Thy1 Homo sapiens cDNA cl | 9.6 |
| 403093 | | | predicted exon | 9.6 |
| 454633 | AW811380 | | "gb: IL3-ST0143-290999-019-D05 ST0143 Homo sapiens c | 9.6 |
| 407291 | AA001464 | | gb: ze45b01.r1 Soares retina N2b4HR Homo sapiens cDNA | 9.5 |
| 455203 | AW865450 | | "gb: PM4-SN0020-010400-008-b09 SN0020 Homo sapiens | 9.5 |
| 403647 | | | predicted exon | 9.5 |
| 401530 | | | predicted exon | 9.5 |
| 414281 | BE269751 | Hs. 288995 | hypothetical protein FLJ20813 | 9.5 |
| 411057 | AW815098 | | "gb: QV4-ST0212-091199-023-f10 ST0212 Homo sapiens c | 9.5 |

TABLE 1A-continued

ABOUT 1119 UP-REGULATED OVARIAN CANCER GENES

| Pkey | Ex Accn No | UG ID | Title | ratio |
|---|---|---|---|---|
| 415953 | H14425 | Hs. 27947 | ESTs | 9.5 |
| 450174 | T82121 | Hs. 177285 | ESTs | 9.5 |
| 422949 | AA319435 | | "gb: EST21657 Adrenal gland tumor *Homo sapiens* cDNA 5 | 9.5 |
| 402112 | R58624 | Hs. 2186 | eukaryotic translation elongation factor 1 gamma | 9.5 |
| 457886 | AA742279 | Hs. 293346 | ESTs | 9.4 |
| 458145 | AI239457 | Hs. 130794 | ESTs | 9.4 |
| 452332 | AW014859 | Hs. 101657 | ESTs | 9.4 |
| 434950 | AW974892 | | "gb: EST386997 MAGE resequences, MAGN Homo sapien | 9.3 |
| 409601 | AF237621 | Hs. 80828 | keratin 1 (epidermolytic hyperkeratosis) | 9.3 |
| 419968 | X04430 | Hs. 93913 | "interleukin 6 (interferon, beta 2)" | 9.3 |
| 436211 | AK001581 | Hs. 80961 | "polymerase (DNA directed), gamma" | 9.3 |
| 428412 | AA428240 | Hs. 126083 | ESTs | 9.3 |
| 449441 | AI656040 | Hs. 196532 | ESTs | 9.3 |
| 458771 | AW295151 | Hs. 163612 | ESTs | 9.3 |
| 458543 | AA213403 | Hs. 257542 | ESTs | 9.3 |
| 414257 | AI828600 | Hs. 21124 | "ESTs, Weakly similar to ALU8_HUMAN ALU SUBFAM | 9.3 |
| 442826 | AI018777 | Hs. 131241 | ESTs | 9.3 |
| 446740 | AI611635 | Hs. 192605 | ESTs | 9.2 |
| 408938 | AA059013 | Hs. 22607 | ESTs | 9.2 |
| 434157 | AI538316 | Hs. 158451 | ESTs | 9.2 |
| 408774 | AW270899 | Hs. 254569 | ESTs | 9.2 |
| 424268 | AA397653 | Hs. 144339 | Human DNA sequence from clone 495O10 on chromosome | 9.2 |
| 415715 | F30364 | | "gb: HSPD20786 HM3 *Homo sapiens* cDNA clone s400009 | 9.1 |
| 405277 | | | predicted exon | 9.1 |
| 412167 | AW897230 | | "gb: CM0-NN0057-150400-335-a11 NN0057 *Homo sapiens* | 9.1 |
| 442771 | AW409808 | Hs. 101550 | ESTs | 9.1 |
| 404898 | | | predicted exon | 9.1 |
| 401230 | | | predicted exon | 9.1 |
| 400623 | | | predicted exon | 9.1 |
| 418808 | AI821836 | Hs. 10359 | ESTs | 9.1 |
| 436396 | AI683487 | Hs. 299112 | "*Homo sapiens* cDNA FLJ11441 fis, clone HEMBA100132 | 9.1 |
| 440466 | AA885871 | Hs. 135727 | ESTs | 9.0 |
| 437568 | AI954795 | Hs. 156135 | ESTs | 9.0 |
| 405382 | | | predicted exon | 9.0 |
| 435673 | AF202961 | Hs. 284200 | "*Homo sapiens* uncharacterized gastric protein ZG12P mRN | 9.0 |
| 405848 | | | predicted exon | 9.0 |
| 437229 | AW976005 | | "gb: EST388114 MAGE resequences, MAGN Homo sapien | 9.0 |
| 417728 | AW138437 | Hs. 24790 | KIAA1573 protein | 9.0 |
| 454597 | AW809648 | | "gb: MR4-ST0124-261099-015-d01 ST0124 *Homo sapiens* | 9.0 |
| 427093 | AA398118 | Hs. 97579 | ESTs | 9.0 |
| 408000 | L11690 | Hs. 620 | bullous pemphigoid antigen 1 (230/240 kD) | 9.0 |
| 440556 | AW206958 | Hs. 125968 | ESTs | 9.0 |
| 400163 | | | predicted exon | 8.9 |
| 420120 | AL049610 | Hs. 95243 | transcription elongation factor A (SII)-like 1 | 8.9 |
| 417549 | AA203651 | | gb: zx58f10.r1 Soares_fetal_liver_spleen_1NFLS_S1 Homo | 8.9 |
| 406163 | | | predicted exon | 8.9 |
| 437918 | AI761449 | Hs. 121629 | ESTs | 8.9 |
| 449419 | R34910 | Hs. 119172 | ESTs | 8.9 |
| 434683 | AW298724 | Hs. 202639 | ESTs | 8.9 |
| 418432 | M14156 | Hs. 85112 | insulin-like growth factor 1 (somatomedia C) | 8.9 |
| 454590 | AW809762 | Hs. 222056 | "*Homo sapiens* cDNA FLJ11572 fis, clone HEMBA100337 | 8.8 |
| 454574 | AW809109 | | "gb: MR4-ST0117-070100-027-a04 ST0117 *Homo sapiens* c | 8.8 |
| 441433 | AA933809 | Hs. 42746 | ESTs | 8.8 |
| 416858 | AW979294 | Hs. 85634 | ESTs | 8.8 |
| 421978 | AJ243662 | Hs. 110196 | NICE-1 protein | 8.8 |
| 451528 | AA018297 | Hs. 35493 | ESTs | 8.8 |
| 408751 | N91553 | Hs. 258343 | ESTs | 8.7 |
| 401862 | | | predicted exon | 8.7 |
| 417344 | AW997313 | | "gb: RC2-BN0048-250400-018-f12 BN0048 *Homo sapiens* | 8.7 |
| 454455 | AW752710 | | "gb: IL3-CT0219-281099-024-A03 CT0219 *Homo sapiens* c | 8.7 |
| 455592 | BE008002 | | "gb: QV0-BN0147-290400-214-h04 BN0147 *Homo sapiens* | 8.7 |
| 417650 | T05870 | Hs. 100640 | ESTs | 8.7 |
| 456309 | AA225423 | | "gb: nc24a12.r1 NCI_CGAP_Pr1 *Homo sapiens* cDNA clon | 8.7 |
| 432030 | AI908400 | Hs. 143789 | ESTs | 8.7 |
| 421492 | BE176990 | Hs. 104916 | hypothetical protein FLJ21940 | 8.7 |
| 402576 | | | predicted exon | 8.7 |
| 426874 | N67325 | Hs. 247132 | ESTs | 8.7 |
| 403334 | | | predicted axon | 8.7 |
| 408562 | AI436323 | Hs. 31141 | "*Homo sapiens* mRNA for KIAA1568 protein, partial cds" | 8.7 |
| 439443 | AF086261 | Hs. 127892 | ESTs | 8.7 |
| 428600 | AW863261 | Hs. 15036 | "ESTs, Highly similar to AF161358_1 HSPC095 [*H. sapiens* | 8.7 |
| 414539 | BE379046 | | "gb: 601236646F1 NIH_MGC_44 *Homo sapiens* cDNA clon | 8.8 |
| 432527 | AW975028 | Hs. 102754 | ESTs | 8.6 |
| 403273 | | | predicted exon | 8.6 |
| 452077 | BE144949 | | "gb: RC2-HT0187-041099-011-d12 HT0187 *Homo sapiens* | 8.6 |

TABLE 1A-continued

ABOUT 1119 UP-REGULATED OVARIAN CANCER GENES

| Pkey | Ex Accn No | UG ID | Title | ratio |
|---|---|---|---|---|
| 444598 | AI288830 | Hs. 149924 | ESTs | 8.6 |
| 434066 | AF116649 | Hs. 283944 | "*Homo sapiens* PRO0566 mRNA, complete cds" | 8.6 |
| 429643 | AA455889 | Hs. 187548 | ESTs | 8.6 |
| 432340 | AA534222 | | gb: nj21d02.s1 NCI_CGAP_AA1 *Homo sapiens* cDNA clon | 8.6 |
| 446142 | AI754693 | Hs. 145968 | ESTs | 8.6 |
| 417412 | X16896 | Hs. 82112 | "interleukin 1 receptor, type I" | 8.6 |
| 416913 | AW934714 | | "gb: RC1-DT0001-031299-011-a11 DT0001 *Homo sapiens*" | 8.5 |
| 451318 | AA029888 | Hs. 95071 | ESTs | 8.5 |
| 405547 | | | predicted exon | 8.5 |
| 423843 | AA332652 | | gb: EST36627 Embryo, 8 week I *Homo sapiens* cDNA 5' en | 8.5 |
| 454145 | AA046872 | Hs. 62798 | ESTs | 8.4 |
| 401200 | | | predicted exon | 8.4 |
| 404166 | | | predicted exon | 8.4 |
| 412761 | AW995092 | | "gb: QV0-BN0041-030300-145-a10 BN0041 Homs sapiens" | 8.4 |
| 412333 | AW937485 | | "gb: QV3-DT0044-221299-045-b09 DT0044 *Homo sapiens*" | 8.4 |
| 455092 | BE152428 | | "gb: CM0-HT0323-151299-126-b04 HT0323 *Homo sapiens*" | 8.4 |
| 419281 | H96452 | Hs. 42189 | ESTs | 8.4 |
| 446171 | AI374927 | | "gb: ta66c04.x1 Soares_total_fetus_Nb2HF8_9w Homo sapie" | 8.3 |
| 437362 | AL359561 | Hs. 16493 | hypothetical protein DKFZp762N2316 | 8.3 |
| 402631 | | | predicted exon | 8.3 |
| 458573 | AV653838 | Hs. 295131 | ESTs | 8.3 |
| 439185 | AF087976 | Hs. 233343 | ESTs | 8.3 |
| 445881 | AI263029 | Hs. 210689 | ESTs | 8.3 |
| 449737 | AI668581 | Hs. 246316 | ESTs | 8.3 |
| 401830 | AJ004832 | Hs. 5038 | neuropathy target esterase | 8.3 |
| 421991 | NM_014918 | Hs. 110488 | KIAA0990 protein | 8.3 |
| 416996 | W91892 | Hs. 59609 | ESTs | 8.2 |
| 443626 | AI540644 | Hs. 138479 | "ESTs, Moderately similar to ALU7_HUMAN ALU SUBF" | 8.2 |
| 407471 | D55644 | | gb: Human spleen PABL (pseudoautosomal boundary-like se | 8.2 |
| 402664 | | | predicted exon | 8.2 |
| 417682 | W69561 | | gb: zd47a08.r1 Soares_fetal_heart_NbHH19W Homo sapien | 8.2 |
| 424983 | AI742434 | Hs. 169911 | ESTs | 8.2 |
| 434353 | AA630863 | Hs. 131375 | "ESTs, Weakly similar to ALUB_HUMAN !!!! ALU CLAS" | 8.2 |
| 453448 | AL036710 | Hs. 209527 | ESTs | 8.2 |
| 455121 | BE156459 | | "gb: QV0-HT0368-040100-082-f06 HT0368 *Homo sapiens*" | 8.2 |
| 404270 | | | predicted exon | 8.1 |
| 438297 | AW515196 | Hs. 258238 | "ESTs, Moderately similar to ALU1_HUMAN ALU SUBF" | 8.1 |
| 418122 | R42778 | Hs. 22217 | ESTs | 8.1 |
| 419929 | U90268 | Hs. 93810 | cerebral cavernous malformations 1 | 8.1 |
| 400925 | | | predicted exon | 8.1 |
| 403350 | | | predicted exon | 8.1 |
| 426116 | AA868729 | Hs. 144694 | ESTs | 8.1 |
| 441518 | AW161697 | Hs. 294150 | ESTs | 8.1 |
| 421888 | AA299780 | Hs. 121036 | ESTs | 8.1 |
| 402745 | | | predicted exon | 8.1 |
| 462071 | | | predicted exon | 8.1 |
| 444781 | NM_014400 | Hs. 11950 | GPI-anchored metastasis-associated protein homolog | 8.0 |
| 430372 | AI206173 | Hs. 211375 | ESTs | 8.0 |
| 449867 | AI672379 | Hs. 73919 | "clathrin, light polypeptide (Lcb)" | 8.0 |
| 422174 | AL049325 | Hs. 112493 | *Homo sapiens* mRNA, cDNA DKFZp564D036 (from clone | 8.0 |
| 413382 | BE090689 | | "gb: RC1-BT0720-280300-011-f08 BT0720 *Homo sapiens* c" | 8.0 |
| 456502 | AI798611 | Hs. 157277 | ESTs | 8.0 |
| 405336 | | | predicted exon | 8.0 |
| 405917 | | | predicted exon | 8.0 |
| 436007 | AI247716 | Hs. 232168 | ESTs | 8.0 |
| 439192 | AW970536 | Hs. 105413 | ESTs | 8.0 |
| 437724 | AW444828 | Hs. 184323 | ESTs | 8.0 |
| 452755 | AW138937 | Hs. 213436 | ESTs | 8.0 |
| 401781 | | | predicted exon | 7.9 |
| 406057 | | | predicted exon | 7.9 |
| 406289 | AW068311 | Hs. 82582 | "integrin, beta-like 1 (with EGF-like repeat domains)" | 7.9 |
| 421459 | AI821539 | Hs. 97249 | ESTs | 7.9 |
| 448251 | BE280486 | Hs. 84045 | "*Homo sapiens* cDNA FLJ11979 fis, clone HEMBB100128" | 7.9 |
| 429125 | AA446854 | Hs. 271004 | ESTs | 7.9 |
| 440154 | BE077129 | Hs. 126119 | "*Homo sapiens* cDNA FLJ13273 fis, clone OVARC100101" | 7.9 |
| 413233 | AW578713 | Hs. 47534 | "ESTs, Weakly similar to ORF YKL201c [*S. cerenisiae*]" | 7.9 |
| 438268 | AA782163 | Hs. 293502 | ESTs | 7.9 |
| 452466 | N84635 | Hs. 29664 | Human DNA sequence from clone 682J15 on chromosome 6 | 7.9 |
| 441194 | BE274581 | | "gb: 601 120870F1 NIH_LMGC_20 *Homo sapiens* cDNA clon" | 7.9 |
| 425292 | NM_005824 | Hs. 155545 | 37 kDa leucine-rich repeat (LRR) protein | 7.9 |
| 445090 | AW205208 | Hs. 147293 | ESTs | 7.9 |
| 431292 | AA370141 | Hs. 251453 | Human DNA sequence from clone 967N21 on chromosome | 7.9 |
| 414266 | BE267834 | | "gb: 601 124428F1 NIH_MGC_8 *Homo sapiens* cDNA clone" | 7.8 |
| 407839 | AA045144 | Hs. 161566 | ESTs | 7.8 |
| 456101 | AA159478 | | gb: zo74d06 s1 Stratagene pancreas (937208) *Homo sapiens* | 7.8 |

TABLE 1A-continued

ABOUT 1119 UP-REGULATED OVARIAN CANCER GENES

| Pkey | Ex Accn No | UG ID | Title | ratio |
|---|---|---|---|---|
| 455853 | BE147225 | | "gb: PM2-HT0225-031299-003-f11 HT0225 *Homo sapiens* | 7.8 |
| 414995 | C18200 | | gb: C18200 Human placenta cDNA (TFujiwara) Homo sapie | 7.8 |
| 447247 | AW369351 | Hs. 287955 | "*Homo sapiens* cDNA FLJ13090 fis, clone NT2RP3002142 | 7.8 |
| 416151 | T26661 | | "gb: AB6SC7R Infant brain, LLNL array of Dr M. Soares 1 | 7.8 |
| 446435 | AW206737 | Hs. 253582 | ESTs | 7.8 |
| 403698 | | | predicted exon | 7.8 |
| 424914 | AA348410 | Hs. 119065 | ESTs | 7.8 |
| 409731 | AA125985 | Hs. 56145 | "thymosin, beta, identified in neuroblastoma cells" | 7.8 |
| 401604 | | | predicted exon | 7.8 |
| 413025 | AA805265 | Hs. 291646 | ESTs | 7.8 |
| 405896 | | | predicted exon | 7.8 |
| 454505 | AW801365 | | "gb: IL5-UM0067-240300-050-a01 UM0067 *Homo sapiens* | 7.7 |
| 448283 | AI340402 | Hs. 182979 | ribosomal protein L12 | 7.7 |
| 434098 | AA625499 | | "gb: af69g08.r1 Soares__NhHMPu__S1 *Homo sapiens* cDNA | 7.7 |
| 431673 | AW971302 | Hs. 293233 | ESTs | 7.7 |
| 421029 | AW057782 | Hs. 293053 | ESTs | 7.7 |
| 408391 | AW859276 | | "gb: MR1-CT0352-240200-105-d02 CT0352 *Homo sapiens* | 7.7 |
| 422529 | AW015128 | Hs. 256703 | ESTs | 7.7 |
| 454389 | AW752571 | | "gb: IL3-CT0213-170100-055-F02 CT0213 Homo sapien c | 7.7 |
| 427821 | AA470158 | Hs. 98202 | ESTs | 7.7 |
| 434657 | AA641876 | Hs. 191840 | ESTs | 7.7 |
| 445628 | AI344166 | Hs. 155743 | ESTs | 7.7 |
| 424872 | AA347923 | | "gb: EST54302 Fetal heart II *Homo sapiens* cDNA 5' end, m | 7.7 |
| 439232 | N48590 | Hs. 46693 | ESTs | 7.7 |
| 441417 | AI733297 | Hs. 144474 | ESTs | 7.7 |
| 453596 | AA441838 | Hs. 62905 | ESTs | 7.7 |
| 430440 | X52599 | Hs. 2561 | "nerve growth factor, beta polypeptide" | 7.7 |
| 413306 | AW303544 | Hs. 118654 | ESTs | 7.7 |
| 400968 | | | predicted exon | 7.7 |
| 446726 | AW300144 | Hs. 209209 | "*Homo sapiens* cDNA FLJ11629 fis, clone HEMBA100424 | 7.7 |
| 427504 | AA776743 | Hs. 191589 | ESTs | 7.7 |
| 405621 | | | predicted exon | 7.6 |
| 414127 | AI431863 | Hs. 135270 | ESTs | 7.6 |
| 409866 | AW502152 | | gb: UI-HF-BR0p-air-f-11-0-UI.r1 NIH__MGC__52 Homo sap | 7.6 |
| 446232 | AI281848 | Hs. 165547 | ESTs | 7.6 |
| 403568 | | | predicted exon | 7.6 |
| 451458 | AI797558 | Hs. 270820 | ESTs | 7.6 |
| 439157 | AA912737 | Hs. 20160 | ESTs | 7.6 |
| 401793 | | | predicted exon | 7.6 |
| 429839 | AI190291 | Hs. 112143 | ESTs | 7.6 |
| 445672 | AI907438 | Hs. 282862 | ESTs | 7.6 |
| 449444 | AW818436 | Hs. 23590 | "solute carrier family 16 (monocarboxylic acid transporters) | 7.6 |
| 447499 | AW262580 | Hs. 147674 | KIAA1621 protein | 7.6 |
| 421773 | W69233 | Hs. 112457 | ESTs | 7.6 |
| 439706 | AW872527 | Hs. 59761 | ESTs | 7.5 |
| 432189 | AA527941 | | "gb: nh30c04 s1 NCI__CGAP__Pr3 *Homo sapiens* cDNA clon | 7.5 |
| 402050 | | | predicted exon | 7.5 |
| 429687 | AI675749 | Hs. 211608 | nucleoporin 153kD | 7.5 |
| 423193 | R07299 | Hs. 254837 | "*Homo sapiens* cDNA FLJ13502 fis, clone PLACE 1004636 | 7.5 |
| 416548 | H62953 | | gb: yr47t06.r1 Soares fetal liver spleen 1NFLS Homo sapien | 7.5 |
| 443236 | AI079496 | Hs. 134169 | ESTs | 7.5 |
| 436053 | AI057224 | Hs. 15443 | ESTs | 7.4 |
| 437191 | NM__006846 | Hs. 5476 | "senne protease inhibitor, Kazal type, 5" | 7.4 |
| 451829 | AW964081 | Hs. 247377 | ESTs | 7.4 |
| 443151 | AI827193 | Hs. 132714 | ESTs | 7.4 |
| 452055 | AI377431 | Hs. 293772 | ESTs | 7.4 |
| 445265 | AI218295 | Hs. 144942 | ESTs | 7.4 |
| 401032 | | | predicted exon | 7.4 |
| 448184 | BE541249 | Hs. 109697 | ESTs | 7.4 |
| 414808 | T95945 | | gb: ye42e02.r1 Soares fetal liver spleen 1NFLS Homo sapine | 7.4 |
| 418540 | AI821597 | Hs. 90877 | "ESTs, Weakly similar to ALU1__HUMAN ALU SUBFAM | 7.4 |
| 410449 | AW748954 | Hs. 18192 | Ser/Arg-related nuclear matrix protein (plenty of prolines 1 | 7.4 |
| 435568 | AA688048 | Hs. 294080 | ESTs | 7.4 |
| 459160 | AI904723 | | "gb: CM-BT066-120299-092 BT066 *Homo sapiens* cDNA, | 7.4 |
| 419753 | N42531 | | gb: yy11c 2.r1 Soares melanocyte 2NbHM *Homo sapiens* cD | 7.4 |
| 432383 | AK000144 | Hs. 274449 | "*Homo sapiens* cDNA FLJ20137 fis, clone C0L07137" | 7.4 |
| 404893 | | | predicted xeon | 7.4 |
| 425349 | AA425234 | Hs. 79886 | ribose 5-phosphate isomerase A (ribose 5-phosphate epimer | 7.4 |
| 413864 | BE175582 | | "gb: RCS-HT0580-100500-022-C01 HT0580 *Homo sapiens* | 7.3 |
| 426871 | AA393041 | Hs. 216493 | ESTs | 7.3 |
| 415613 | R20233 | | gb: yg18h11.r1 Soares infant brain 1NIB *Homo sapiens* cDN | 7.3 |
| 427025 | AA397589 | Hs. 97523 | ESTs | 7.3 |
| 444683 | AI375101 | Hs. 158721 | "ESTs, Weakly similar to ALU1__HUMAN ALU SUBFAM | 7.3 |
| 447700 | AI420183 | Hs. 171077 | "ESTs, Weakly similar to similar to serine/threoninse kinase | 7.3 |
| 412740 | AW993984 | | "gb: RC1-BN0035-130400-013-a05 BN0035 *Homo sapiens* | 7.3 |

TABLE 1A-continued

ABOUT 1119 UP-REGULATED OVARIAN CANCER GENES

| Pkey | Ex Accn No | UG ID | Title | ratio |
|---|---|---|---|---|
| 416642 | T96118 | Hs. 226313 | "ESTs, Weakly similar to ALU1_HUMAN ALU SUBFAM | 7.3 |
| 416506 | H59879 | Hs. 237306 | ESTs | 7.3 |
| 426130 | AA853282 | | gb: NHTBCae04f07.r1 Normal Human Trahecular Bone Cell | 7.3 |
| 407392 | AB032369 | | "gb: Home sapiens MIST mRNA, partial cds" | 7.3 |
| 432365 | AK001106 | Hs. 274419 | hypothetical protein FLJ10244 | 7.3 |
| 451221 | AI949701 | Hs. 210589 | ESTs | 7.3 |
| 443161 | AI038316 | | gb: ox48c08.x1 Soares_total_fetus_Nb2HF8_9W Homo sapie | 7.3 |
| 418186 | BE541042 | Hs. 23240 | "Homo sapiens cDNA FLJ13496 fis, clone PLACE1004471 | 7.3 |
| 439152 | H65014 | | gb: yu66t10.r1 Weizmann Olfactory Epithulium Homo sapie | 7.2 |
| 459534 | BE386808 | Hs. 147905 | ESTs | 7.2 |
| 443326 | BE156494 | Hs. 188478 | ESTs | 7.2 |
| 417351 | T90278 | Hs. 15049 | ESTs | 7.2 |
| 454182 | AW177335 | | "gb: CM1-CT0129-180899-006-b08 C10129 Homo sapiens | 7.2 |
| 402298 | | | predicted exon | 7.2 |
| 458562 | N34128 | Hs. 145268 | ESTs | 7.2 |
| 407021 | U52077 | | "gb: Humun manner1 transposase gene, complete consensus | 7.2 |
| 449276 | AW241510 | Hs. 252713 | ESTs | 7.2 |
| 418251 | AA832123 | Hs. 177723 | ESTs | 7.2 |
| 420788 | AA937957 | Hs. 193367 | ESTs | 7.2 |
| 401881 | | | predicted xeon | 7.2 |
| 456436 | AA251079 | Hs. 158386 | ESTs | 7.2 |
| 413425 | F20956 | | "gb: HSPD05390 HM3 Homo sapiens cDNA clone 032-X4- | 7.2 |
| 448966 | AW372914 | Hs. 287462 | "Homo sapiens cDNA FLJ11875 fis, clone HEMBA100707 | 7.2 |
| 429340 | N35938 | Hs. 199429 | Homo sapiens mRNA, cDNA DKFZp434M2216 (from clon | 7.2 |
| 406053 | | | predicted exon | 7.2 |
| 405851 | | | predicted exon | 7.2 |
| 431009 | BE149762 | Hs. 248213 | "gap lunction protein, beta 6 (connexin 30)" | 7.2 |
| 426662 | AA879474 | Hs. 122710 | ESTs | 7.2 |
| 408536 | AW381532 | Hs. 135188 | ESTs | 7.1 |
| 455013 | BE073250 | | "gb: MR0-BT0551-060300-102-e05 BT0551 Homo sapiens | 7.1 |
| 428910 | W03667 | Hs. 193792 | ESTs | 7.1 |
| 424634 | NM_003613 | Hs. 151407 | "cartilage intermediate layer protein, nucleotide pyrophosph | 7.1 |
| 449794 | AW444502 | HS.256982 | "ESTs, Highly similar to AF116865 1 hedgehog-interacting | 7.1 |
| 423410 | AF058989 | Hs. 128231 | "G antigen, family B, 1 (prostate associated)" | 7.1 |
| 445460 | AI797473 | Hs. 209468 | ESTs | 7.1 |
| 447285 | AI371849 | Hs. 200696 | "ATPase, Class VI, type 11C" | 7.1 |
| 419750 | AL079741 | Hs. 183114 | "Homo sapiens cDNA FLJ14236 fis, clone NT2RP4000515 | 7.1 |
| 438986 | AF085888 | Hs. 269307 | ESTs | 7.1 |
| 420757 | X78592 | Hs. 99915 | androgen receptor (dihydrotestosterone receptor, testicular | 7.1 |
| 432479 | AL042844 | Hs. 275675 | katanin p80 (WD40-containing) subunit B 1 | 7.1 |
| 449733 | R74546 | Hs. 29438 | "Homo sapiens cDNA FLJ12094 fis, clone HEMBB100260 | 7.1 |
| 437846 | AA773866 | Hs. 244569 | ESTs | 7.1 |
| 454934 | AW846080 | | "gb: MR3-CT0176-081099-002-b09 CT0176 Homo sapiens | 7.1 |
| 421929 | AA300543 | Hs. 247360 | ESTs | 7.1 |
| 401780 | | | predicted exon | 7.0 |
| 448106 | AI800470 | Hs. 171941 | ESTs | 7.0 |
| 448835 | BE277929 | Hs. 11081 | "ESTs, Weakly similar to S57447 HPBRII-7 protein [H. sap | 7.0 |
| 400842 | | | predicted exon | 7.0 |
| 429364 | AA451797 | Hs. 201202 | "ESTs, Moderately similar to Pre-Pol-dUTPase polyprolein | 7.0 |
| 454963 | AW847647 | | "gb: IL3-CT0213-280100-056-A06 CT0213 Homo sapiens c | 7.0 |
| 423891 | AK002042 | Hs. 134795 | "Homo sapiens cDNA FLJ11180 fis, clone PLACE1007452 | 7.0 |
| 407506 | U71600 | | "gb: Human zinc finger protein zfp31 (zf31) mRNA, partial | 7.0 |
| 413802 | AW964490 | Hs. 32241 | ESTs | 7.0 |
| 440051 | BE559980 | | "gb: 601345293F1 NIH_MGC_8 Homo sapiens cDNA clone | 7.0 |
| 446283 | AI948801 | Hs. 171073 | ESTs | 7.0 |
| 419236 | AA330447 | Hs. 135159 | "Home sapiens cDNA FLJ11481 fis, clone HEMBA100180 | 7.0 |
| 405472 | | | predicted exon | 7.0 |
| 435024 | AI863518 | Hs. 127743 | "ESTs, Weakly similar to V-ATPase G-subunit like protein | 7.0 |
| 453969 | AW090783 | Hs. 301731 | "Home sapiens cDNA FLJ11738 fie, clone HEMBA100547 | 7.0 |
| 404992 | | | predicted exon | 7.0 |
| 428129 | AI244311 | Hs. 26912 | ESTs | 7.0 |
| 414315 | Z24878 | | "gb: HSB65D052 STRATACENE Human skeletal muscle cD | 7.0 |
| 400491 | H25530 | Hs. 50868 | "solute carrier family 22 (organic cation transporter), memb | 6.9 |
| 459275 | AI808913 | Hs. 118321 | ESTs | 6.9 |
| 450853 | AA479629 | Hs. 44243 | ESTs | 6.9 |
| 457460 | AI143312 | Hs. 164004 | ESTs | 6.9 |
| 434168 | AI204525 | Hs. 116156 | ESTs | 6.9 |
| 445153 | AI214671 | | "gb: qm32d02.x1 NCI_CGAP_Lu5 Homo sapiens cDNA clo | 6.9 |
| 450028 | AI912012 | Hs. 200737 | ESTs | 6.9 |
| 414954 | D81402 | | gb: HUM162A03B Human fetal brain (TFujiwara) Homo sa | 6.9 |
| 459478 | AW195566 | Hs. 253182 | ESTs | 6.9 |
| 426269 | H15302 | Hs. 168950 | Homo sapiens mRNA, cDNA DKFZp566A1046 (from clon | 6.9 |
| 401050 | | | predicted exon | 6.9 |
| 447588 | AI394154 | Hs. 279659 | "ESTs, Weakly similar to unknown protein [H. sapiens]" | 6.9 |
| 449002 | AI620018 | Hs. 117461 | ESTs | 6.9 |

TABLE 1A-continued

ABOUT 1119 UP-REGULATED OVARIAN CANCER GENES

| Pkey | Ex Accn No | UG ID | Title | ratio |
|---|---|---|---|---|
| 452759 | AW590773 | Hs. 258996 | ESTs | 6.9 |
| 443220 | R85304 | Hs. 132032 | *Homo sapiens* cDNA FLJ11683 fis, clone HEMBA100490 | 6.9 |
| 400749 | | | predicted exon | 6.8 |
| 406277 | | | predicted exon | 6.8 |
| 433785 | BE044593 | Hs. 112704 | ESTs | 6.8 |
| 434129 | AI807757 | Hs. 221041 | ESTs | 6.8 |
| 453369 | BE551550 | Hs. 232630 | ESTs | 6.8 |
| 411722 | AW875942 | | "gb: CM1-PT0013-131299-067-b10 PT0013 *Homo sapiens* | 6.8 |
| 455152 | AW858621 | | "gb: CM0-CT0342-021299-115-f04 CT0342 *Homo sapiens* | 6.8 |
| 412670 | AA115456 | | gb: zkB9b05.r1 Soares__pregnant__uterus__NbHPU Homo sapi | 6.8 |
| 419054 | N40340 | Hs. 191510 | "ESTs, Weakly similar to ORF2 [*M. muscular*]" | 6.8 |
| 421316 | AA287203 | Hs. 251397 | SMA5 | 6.8 |
| 432363 | AA534489 | | gb: nf76g11 .s1 NCI__CGAP__Co3 *Homo sapiens* cDNA clone | 6.8 |
| 458603 | AW103046 | Hs. 6162 | KIAA0771 protein | 6.8 |
| 439527 | AW298119 | Hs. 202536 | ESTs | 6.8 |
| 408920 | AL120071 | Hs. 48998 | fibronectin leucine rich trasamembrane protein 2 | 6.8 |
| 439127 | AW978465 | Hs. 292368 | ESTs | 6.8 |
| 434890 | AF161345 | Hs. 283930 | "Hamo sapiens HSPC082 mRNA, partial cds" | 6.8 |
| 429413 | NM__014058 | Hs. 201877 | DESC1 protein | 6.7 |
| 407788 | BE514982 | Hs. 38991 | S100 calcium-binding protein A2 | 6.7 |
| 447252 | R90916 | | gb:yn01e10.r1 Soares adult brain N2b4HB55Y Homo sapien | 6.7 |
| 455851 | BE146879 | | "gb: QV4-HT0222-261099-014-c11 HT0222 *Homo sapiens* | 6.7 |
| 439509 | AF086332 | Hs. 58314 | ESTs | 6.7 |
| 418858 | AW961605 | Hs. 21145 | "*Homo sapiens* cDNA FLJ22489 fis, clone HRC10951" | 6.7 |
| 419323 | AI092379 | Hs. 135275 | ESTs | 6.7 |
| 415317 | Z43388 | Hs. 5570 | hypathehcal protein FLJ10006 | 6.7 |
| 418654 | AA226334 | Hs. 154291 | ESTs | 6.7 |
| 407413 | AF067801 | | "gb: *Homo sapiens* HDCGC21P mRNA, complete cds." | 6.7 |
| 439694 | AA843915 | Hs. 54707 | ESTs | 6.7 |
| 451191 | N67900 | Hs. 118446 | ESTs | 6.7 |
| 454006 | U12775 | Hs. 37006 | agouti (mouse)-signaling protein | 6.7 |
| 443657 | R14973 | | gb: yf42f10.s1 Soares fetal liver spleen 1NFLS Homo sapien | 6.7 |
| 455879 | BE153275 | | "gb: PM0-HT0335-180400-008-e11 HT0335 *Homo sapiens* | 6.7 |
| 451368 | BE242152 | Hs. 288417 | protein serine threonine kinase Clk4 | 6.7 |
| 453509 | AL040021 | | gb: DKFZp434N1812__r1 434 (synonym htes3) Homo sapie | 6.7 |
| 420892 | AW975076 | Hs. 172589 | nuclear phosphoprotein similar to *S. cerevisine* PWP1 | 6.7 |
| 423372 | AI246375 | Hs. 154458 | ESTs | 6.7 |
| 450316 | W84446 | Hs. 17850 | ESTs | 6.7 |
| 447795 | AW295151 | Hs. 163612 | ESTs | 6.7 |
| 413252 | BE074910 | | "gb: RC5-5T0580-170300-021-F12 BT0580 *Homo sapiens* | 6.7 |
| 405771 | | | predicted exon | 6.6 |
| 411483 | AW848115 | | "gb: IL3-CT0214-301299-048-C09 CT0214 *Homo sapiens* c | 6.6 |
| 420271 | AI954365 | Hs. 42892 | ESTs | 6.6 |
| 431948 | AA917706 | Hs. 194616 | ESTs | 6.6 |
| 409629 | AW449589 | Hs. 279724 | ESTs | 6.6 |
| 458841 | W28965 | | gb: 54d10 Human retran cDNA randomly primed sublibrary | 6.6 |
| 416565 | AW000960 | Hs. 44970 | ESTs | 6.6 |
| 409097 | AA677927 | Hs. 144269 | ESTs | 6.6 |
| 441832 | AI018249 | Hs. 128062 | ESTs | 6.6 |
| 457285 | AI038858 | Hs. 228780 | "ESTs, Highly similar to AF199597__1 A-type potassium cha | 6.6 |
| 406504 | | | predicted exon | 6.6 |
| 414606 | BE387771 | | "gb: 601283251F1 NIH__MGC__44 *Homo sapiens* cDNA clon | 6.6 |
| 452956 | AW003578 | Hs. 231872 | ESTs | 6.6 |
| 410743 | AA089474 | Hs. 272153 | ESTs | 6.6 |
| 404599 | | | predicted exon | 6.6 |
| 423575 | C18863 | Hs. 163443 | "*Homo sapiens* cDNA FLJ11576 fis, clone HEMBA100354 | 6.6 |
| 443027 | AI027847 | Hs. 253550 | ESTs | 6.6 |
| 458663 | AV658444 | Hs. 280776 | "*Homo sapiens* cDNA FLJ13684 fis, clone PLACE2000021 | 6.6 |
| 431277 | AA501806 | Hs. 249965 | ESTs | 6.6 |
| 445232 | BE294357 | | "gb: 601172878F1 NIH__MGC__17 *Homo sapiens* cDNA clon | 6.6 |
| 459170 | AI905518 | | "gb: RC-BT091-210199-098 BT091 *Homo sapiens* cDNA, m | 6.6 |
| 437876 | AA770151 | Hs. 126424 | ESTs | 6.6 |
| 406752 | AI285598 | Hs. 217493 | annexin A2 | 6.6 |
| 401245 | | | predicted exon | 6.6 |
| 446102 | AW168067 | Hs. 252956 | ESTs | 6.5 |
| 446989 | AK001898 | Hs. 16740 | hypothetical protein FLJ11036 | 6.5 |
| 421160 | AL080215 | Hs. 102301 | *Homo sapiens* mRNA; cDNA DKFZp586J0323 (from clone | 6.5 |
| 458831 | H71739 | Hs. 200227 | ESTs | 6.5 |
| 408914 | AW450309 | | gb: UI-H-B13-akz-g-08-0-UI s1 NCI__CGAP__Sub5 Homo sa | 6.5 |
| 411018 | AW813428 | | "gb: MR3-ST0192-010200-210-c05 ST0192 *Homo sapiens* c | 6.5 |
| 436562 | H71937 | Hs. 169756 | "complement component 1, s subcamponent | 6.5 |
| 457620 | AA602711 | | "gb: np03h06 s1 NCI__CGAP__Pr2 *Homo sapiens* cDNA clon | 6.5 |
| 438647 | AA813118 | Hs. 163230 | ESTs | 6.5 |
| 439570 | T79925 | Hs. 269165 | ESTs | 6.5 |
| 419273 | BE271180 | Hs. 293490 | ESTs | 6.5 |

TABLE 1A-continued

ABOUT 1119 UP-REGULATED OVARIAN CANCER GENES

| Pkey | Ex Accn No | UG ID | Title | ratio |
|---|---|---|---|---|
| 443745 | AB039670 | Hs. 9728 | ALEX1 protein | 6.5 |
| 431029 | BE392725 | Hs. 248571 | *Homo sapiens* PAC clone RP5-1163J12 from 7q21.2–q31.1 | 6.5 |
| 458695 | AV660159 | Hs. 282284 | ESTs | 6.5 |
| 410966 | AW812088 | | "gb: RC4-ST0173-191099-032-a07 ST0173 *Homo sapiens* c | 6.4 |
| 417135 | AA422067 | Hs. 50547 | ESTs | 6.4 |
| 416441 | BE407197 | | "gb: 601301552F1 NIH_MGC_21 *Homo sapiens* cDNA clon | 6.4 |
| 413702 | BE170313 | | "gb: QV4-HT0536-040500-193-g02 HT0536 Homs sapiens | 6.4 |
| 452563 | AI907552 | | "gb: RC-BT147-120499-044 BT147 *Homo sapiens* cDNA, m | 6.4 |
| 408956 | AK001868 | Hs. 295306 | "ESTs, Highly similar to unnamed protein product [H. sapien | 6.4 |
| 406349 | | | predicted exon | 6.4 |
| 425420 | BE536911 | Hs. 234545 | "ESTs, Weakly similar to AF155135_1 novel retinal pigmen | 6.4 |
| 459430 | AW662886 | | gb: hi82h11.x1 Soares_NFL_T_GBC_S1 *Homo sapiens* cDN | 6.4 |
| 425733 | F13287 | Hs. 159388 | Homs sapiens clone 23578 mRNA sequence | 6.4 |
| 458678 | AI306162 | Hs. 170938 | "ESTs, Weakly similar to KIAA0705 protein [*H. sapiens*" | 6.4 |
| 429695 | AA835714 | Hs. 293556 | ESTs | 6.4 |
| 426872 | AA410446 | Hs. 112011 | ESTs, Weakly similar to unknown [*H. sapiens*]" | 6.4 |
| 437152 | AL050027 | | gb: *Homo sapiens* mRNA, cDNA DKFZp566C0324 (from c | 6.4 |
| 440517 | AW139632 | Hs. 132246 | ESTs | 6.4 |
| 450877 | AI799608 | Hs. 29178 | ESTs | 6.4 |
| 410664 | NM_006033 | Hs. 65370 | "lipase, endothelial" | 6.4 |
| 405793 | | | predicted exon | 6.4 |
| 418709 | AA227394 | | gb: zr17c10.r1 Stratagene NT2 neuronal precursor 937230 H. | 6.4 |
| 428684 | AA431792 | Hs. 44784 | ESTs | 6.4 |
| 448516 | AW898595 | | "gb: RC1-NN0073-260400-011-g09 NN0073 *Homo sapiens* | 6.4 |
| 400983 | | | predicted exon | 6.3 |
| 422365 | AF035537 | Hs. 115521 | "REV3 (yeast homolog)-like, catalytic subunit of DNA poly | 6.3 |
| 425612 | BE004257 | | gb: CM0-BN0103-180300-296-c04 BN0103 *Homo sapiens* | 6.3 |
| 401521 | | | predicted exon | 6.3 |
| 430290 | AI734110 | Hs. 136355 | ESTs | 6.3 |
| 414931 | AK000342 | Hs. 77646 | *Homo sapiens* mRNA; cDNA DKFZp761M0223 (from clon | 6.3 |
| 437939 | AW298600 | Hs. 141840 | "ESTs, Weakly similar to S59501 interferon receptor JFNA | 6.3 |
| 451842 | AI820539 | Hs. 267087 | "ESTs, Moderately similar to ALU4_HUMAN ALU SUBF | 6.3 |
| 405810 | | | predicted exon | 6.3 |
| 443747 | AV646352 | | "gb: AV646352 GLC *Homo sapiens* cDNA clone GLCAME | 6.3 |
| 427287 | NM_014903 | Hs. 174188 | KIAA0938 protein | 6.3 |
| 413521 | BE145814 | | "gb: MR0-HT0208-101299-202-a04 HT0208 *Homo sapiens* | 6.3 |
| 429090 | AW820278 | Hs. 99066 | ESTs | 6.3 |
| 451488 | H22999 | Hs. 208846 | ESTs | 6.3 |
| 455713 | BE069891 | | "gb: QV4-BT0401-201299-064-b01 BT0401 *Homo sapiens* | 6.3 |
| 452161 | R43077 | Hs. 221747 | ESTs | 6.3 |
| 428647 | AA830050 | Hs. 124344 | ESTs | 6.3 |
| 445063 | AI246275 | Hs. 149196 | ESTs | 6.3 |
| 456671 | AB011142 | Hs. 114293 | KIAA0570 gene product | 6.3 |
| 401508 | | | predicted exon | 6.3 |
| 412677 | AW029608 | Hs. 17384 | ESTs | 6.3 |
| 441720 | AI346487 | Hs. 28739 | ESTs | 6.3 |
| 418051 | AW192535 | Hs. 19479 | ESTs | 6.3 |
| 438014 | N71183 | Hs. 121806 | "*Homo sapiens* cDNA FLJ1I971 fis, clone HEMSBB100120 | 6.3 |
| 432101 | AI918950 | Hs. 11092 | "*Homo sapiens* cDNA FLJ14290 fis, clone PLACE1006795 | 6.3 |
| 421032 | AW293133 | Hs. 101340 | ESTs | 6.3 |
| 436532 | AA721522 | | gb: nv54h12.r1 NCL_CGAP_Ew1 *Homo sapiens* cDNA clo | 6.3 |
| 431318 | AA502700 | Hs. 293147 | ESTs | 6.3 |
| 413470 | N20934 | | gb: yx5Ac11 s1 Soares melanocyte 2NbHM *Homo sapiens* c | 6.3 |
| 402425 | | | predicted exon | 6.3 |
| 455993 | BE179085 | | "gb: RC0-HT0613-140300-021-d06 HT0613 *Homo sapiens* | 6.3 |
| 400160 | | | predicted exon | 6.3 |
| 413795 | AL040178 | Hs. 142003 | ESTs | 6.2 |
| 405071 | | | predicted exon | 6.2 |
| 403741 | | | predicted exon | 6.2 |
| 432489 | AI804855 | Hs. 207530 | ESTs | 6.2 |
| 402296 | | | predicted exon | 6.2 |
| 446091 | AW022192 | Hs. 200197 | ESTs | 6.2 |
| 444788 | AI871122 | Hs. 202821 | ESTs | 6.2 |
| 404972 | | | predicted exon | 6.2 |
| 400227 | | | predicted exon | 6.2 |
| 433804 | AI936561 | Hs. 112740 | ESTs | 6.2 |
| 448807 | AI571940 | Hs. 7549 | ESTs | 6.2 |
| 404340 | | | predicted exon | 6.2 |
| 424032 | AB014523 | Hs. 151406 | KIAA0623 gene product | 6.2 |
| 449547 | H93543 | Hs. 117963 | ESTs | 6.2 |
| 406945 | K01383 | Hs. 203967 | metallothionein 1A (functional) | 6.2 |
| 433663 | AF083131 | Hs. 229535 | CATX-15 protein | 6.2 |
| 407809 | AW082279 | Hs. 244106 | ESTs | 6.2 |
| 418342 | BE002723 | Hs. 293504 | ESTs, Moderately similar to ALU1_HUMAN ALU SU8F | 6.2 |
| 438007 | AA133008 | Hs. 158675 | ribosomal protein L14 | 6.2 |

TABLE 1A-continued

ABOUT 1119 UP-REGULATED OVARIAN CANCER GENES

| Pkey | Ex Accn No | UG ID | Title | ratio |
|---|---|---|---|---|
| 410536 | N39533 | | gb: yv27d04.s1 Soares fetal liver spleen 1NFLS Homs sapie | 6.2 |
| 448005 | AW207437 | Hs. 170378 | ESTs | 6.2 |
| 414083 | AL121282 | Hs. 257786 | ESTs | 6.2 |
| 405362 | | | predicted exon | 6.2 |
| 410102 | AW248508 | Hs. 279727 | "Homo sapiens cDNA FLJ14035 fis, clone HEMBA100463 | 6.2 |
| 457868 | AW975133 | | gb: EST387239 MAGE resequences, MAGN Homo sapies | 6.2 |
| 407395 | AF005082 | | "gb: Homo sapiens skin-specific protein (xp33) mRNA, part | 6.2 |
| 443603 | BE502601 | Hs. 134289 | "ESTs, Weakly similar to KIAA1063 protein [H. sapiens]" | 6.2 |
| 430051 | AA464611 | Hs. 52515 | transducin (beta)-like 2 | 6.1 |
| 434569 | AI311295 | Hs. 58609 | ESTs | 6.1 |
| 430481 | AA479678 | Hs. 203269 | ESTs, Moderately similar to ALU8_HUMAN ALU SUBF | 6.1 |
| 402859 | | | predicted exon | 6.1 |
| 401260 | | | predicted exon | 6.1 |
| 406544 | | | predicted eson | 6.1 |
| 428446 | AI024600 | Hs. 98612 | ESTs | 6.1 |
| 412246 | AI160873 | Hs. 69233 | "ESTs, Weakly similar to KIAA1064 protein [H. sapiens]" | 6.1 |
| 400420 | AJ277247 | Hs. 287369 | interleukin 22 | 6.1 |
| 455662 | BE065387 | | "gb: RC1-BT0314-030500-016-d03 BT0314 Homo sapiens | 6.1 |
| 428613 | AB037749 | Hs. 186928 | KIAA1328 protein | 6.1 |
| 443267 | AW450630 | Hs. 133851 | ESTs | 6.1 |
| 433405 | AW157566 | Hs. 156892 | ESTs | 6.1 |
| 416795 | AI497778 | Hs. 168053 | "ESTs, Highly similar to AF227948_1 HBV pX associated p | 6.1 |
| 435706 | W31254 | Hs. 7045 | GL004 protein | 6.1 |
| 450769 | AA057418 | Hs. 33654 | ESTs | 6.1 |
| 427174 | AA398848 | Hs. 97541 | ESTs | 6.1 |
| 425389 | AW974499 | Hs. 192183 | ESTs | 6.1 |
| 416675 | H73802 | Hs. 35381 | ESTs | 6.1 |
| 432749 | NM_014438 | Hs. 278909 | Interleukin-1 Superfamily e | 6.1 |
| 401809 | | | predicted exon | 6.1 |
| 403041 | | | predicted exon | 6.0 |
| 408523 | AW833259 | | "gb: RC2-TT0007-131099-011-c01 TT0007 Homo sapiens c | 6.0 |
| 416515 | N91716 | Hs. 194140 | ESTs | 6.0 |
| 452591 | BE173164 | Hs. 1516 | insulin-like growth factor-binding protein 4 | 6.0 |
| 437146 | AA730977 | | "gb: nw55f05.s1 NCI_CGAP_Ew1 Homo sapiens cDNA clo | 6.0 |
| 450094 | AI174947 | Hs. 295789 | Homo sapiens mRNA, cDNA DKFZpS64D1164 (from clon | 6.0 |
| 402529 | | | predicted exon | 6.0 |
| 430706 | NM_003540 | Hs. 247816 | "H4 histone family, member C" | 6.0 |
| 459186 | AI908287 | | "gb: RC-BT168-020499-035 BT168 Homo sapiens cDNA, m | 6.0 |
| 452158 | AI699120 | Hs. 61198 | ESTs | 6.0 |
| 411237 | AW833676 | | "gb: QV4-TT0008-181199-038-h04 TT0008 Homo sapiens | 6.0 |
| 400441 | AA15530 | Hs. 99879 | B-cell growth factor 1 (12 kD) | 6.0 |
| 439398 | AA284267 | Hs. 221504 | ESTs | 6.0 |
| 440862 | H39048 | Hs. 127432 | ESTs | 6.0 |
| 415451 | H19415 | Hs. 268720 | "ESTs, Moderately similar to ALU1_HUMAN ALU SUBF | 6.0 |
| 459587 | AA031956 | | gb: zk15e04.s1 Soares_pregnant_uterus_NbHPU Homo sapi | 6.0 |
| 456072 | H54381 | | gb: yq89a03.s1 Soares fetal liver spleen 1NFLS Homo sapie | 6.0 |
| 409954 | AW512770 | Hs. 266457 | ESTs | 6.0 |
| 443488 | AI073495 | Hs. 133912 | "ESTs, Weakly similar to methyl-CpG binding domain-coat | 6.0 |
| 430825 | AI734186 | Hs. 185105 | ESTs | 6.0 |
| 454466 | AA984138 | Hs. 279895 | "Homo sapiens mRNA for KIAA1578 protein, partial cds" | 6.0 |
| 456506 | AA278277 | Hs. 194212 | ESTs | 6.0 |
| 449228 | AJ403107 | Hs. 148590 | "ESTs, Weakly similar to AF208846_1 BM-004 [H. sapiens] | 6.0 |
| 457727 | AW974687 | | "gb: EST386776 MAGE resequences, MAGM Homos sapien | 6.0 |
| 442440 | BE464435 | Hs. 146180 | "ESTs, Weakly similar to non-receptor protein tyrosine kina | 5.9 |
| 455110 | BE154505 | | "gb: PM0-HT0343-281299-003-e06 HT0343 Homo sapiens | 5.9 |
| 402790 | | | predicted exon | 5.9 |
| 409982 | BE005839 | | "gb: RC2-BN0120-250400-012-f03 BN0120 Homo sapiens | 5.9 |
| 427635 | BE397988 | Hs. 179982 | tumor protein p53-binding protein | 5.9 |
| 408948 | AW296713 | Hs. 221441 | ESTs | 5.9 |
| 402046 | | | predicted exon | 5.9 |
| 416438 | R89238 | Hs. 34262 | ESTs | 5.9 |
| 403083 | | | predicted exon | 5.9 |
| 402481 | | | predicted exon | 5.9 |
| 409867 | AW502161 | | gb: UI-HF-BR0p-ajr-g-12-0-UI.r1 NIH_MGC_52 Homo sap | 5.9 |
| 420362 | U79734 | Hs. 97206 | huntingtin interacting protein 1 | 5.9 |
| 421375 | AA489200 | Hs. 100595 | "ESTs, Moderately similar to ALU1_HUMAN ALU SUBF | 5.9 |
| 437630 | AI252782 | Hs. 153029 | ESTs | 5.9 |
| 443500 | AV646388 | Hs. 137071 | ESTs | 5.9 |
| 448995 | AI613276 | Hs. 5662 | "guanine nucleotide binding protein (G protein), beta polyp | 5.9 |
| 438214 | H06076 | Hs. 26320 | TRABID protein | 5.9 |
| 428046 | AW812795 | Hs. 155381 | "ESTs, Moderately similar to I38022 hypothetical protein [H. | 5.9 |
| 431941 | AK000106 | Hs. 272227 | "Homo sapiens cDNA FLJ20099 fis, clone COL04544" | 5.9 |
| 403356 | | | predicted exon | 5.9 |
| 439031 | AF075079 | | gb: Homo sapiens full length insert cDNA YQ80A08 | 5.9 |
| 430032 | AW936136 | Hs. 99610 | ESTs | 5.9 |

TABLE 1A-continued

ABOUT 1119 UP-REGULATED OVARIAN CANCER GENES

| Pkey | Ex Accn No | UG ID | Title | ratio |
|---|---|---|---|---|
| 423457 | F08208 | Hs. 155606 | paired mesoderm homeo box 1 | 5.9 |
| 422158 | L10343 | Hs. 112341 | "protease inhibitor 3, skin-derived (SKALP)" | 5.9 |
| 406592 | | | predicted exon | 5.9 |
| 418636 | AW749855 | | "gb: QV4-BT0534-281299-053-c05 BT0534 *Homo sapiens* | 5.8 |
| 429399 | AA452244 | Hs. 16727 | ESTs | 5.8 |
| 408590 | AW238162 | Hs. 253873 | ESTs | 5.8 |
| 422168 | AA586894 | Hs. 112408 | S100 calcium-binding protein A7 (psonasin 1) | 5.8 |
| 417421 | AL138201 | Hs. 82120 | "nuclear receptor subfamily 4, group A, member 2" | 5.8 |
| 401129 | | | predicted exon | 5.8 |
| 434745 | AW974445 | Hs. 185155 | "ESTs, Weakly similar to HuEMAP [*H. sapiens*]" | 5.8 |
| 402800 | | | predicted exon | 5.8 |
| 436185 | AW753380 | Hs. 49753 | "*Homo sapiens* mRNA for KIAA1561 protein, partial cds" | 5.8 |
| 419519 | AI198719 | Hs. 176376 | ESTs | 5.8 |
| 452542 | AW812256 | | "gb: RC0-ST0174-191099-031-a07 ST0174 *Homo sapiens* c | 5.8 |
| 427166 | AA431576 | Hs. 155658 | ESTs | 5.8 |
| 416168 | H23687 | | gb: yn72d12.r1 Soares adult brain N2b5HB55Y Homo sapie | 5.8 |
| 431467 | N71831 | Hs. 256398 | *Homo sapiens* mRNA, cDNA DKFZp434E0528 (from clon | 5.8 |
| 421558 | AB011125 | Hs. 105749 | KIAA0553 protein | 5.8 |
| 458055 | AW979121 | Hs. 131375 | "ESTs, Weakly similar to ALUB_HUMAN !!!! ALU CLAS | 5.8 |
| 418345 | AJ001696 | Hs. 241407 | "serine (or cysteine) proteinase inhibitor, clade B (ovalbumi | 5.8 |
| 426544 | AA492325 | | gb: ng81b11.s1 NCI_CGAP_Pr6 *Homo sapiens* cDNA clone | 5.8 |
| 433544 | AI793211 | Hs. 165372 | "ESTs, Moderately similar to ALU1_HUMAN ALU SUBF | 5.8 |
| 442007 | AA301116 | Hs. 142838 | "*Homo sapiens* cDNA FLJ23444 fis, clone HSI01343" | 5.8 |
| 443422 | R10288 | Hs. 301529 | ESTs | 5.8 |
| 434311 | BE543469 | Hs. 266263 | "*Homo sapiens* cDNA FLJ14115 fis, clone MAMMA10017 | 5.8 |
| 424966 | AU077312 | Hs. 153985 | "solute carrier family 7 (cationic amino acid transporter, y+ | 5.8 |
| 441744 | AA960922 | Hs. 200938 | ESTs | 5.8 |
| 413101 | BE065215 | | "gb: RC1-BT0314-310300-015-f01 BT0314 *Homo sapiens* c | 5.7 |
| 445687 | W80382 | Hs. 149297 | ESTs | 5.7 |
| 441369 | AA931535 | | gb: oo55a04 s1 NCI_CGAP_Lu5 *Homo sapiens* cDNA clon | 5.7 |
| 414428 | BE296906 | Hs. 182625 | VAMP (vesicle-associated membrane protein)-associated pr | 5.7 |
| 431211 | M86849 | Hs. 5566 | "gap junction protein, beta 2, 26 kD (connexin 26)" | 5.7 |
| 411541 | W03940 | | gb: za62b02.r1 Soares fetal liver spleen 1NFLS Homo sapien | 5.7 |
| 448612 | AI696363 | Hs. 171285 | ESTs | 5.7 |
| 419118 | AA234223 | Hs. 139204 | ESTs | 5.7 |
| 406322 | | | predicted exon | 5.7 |
| 454690 | AW854639 | | "gb: MR1-CT0258-140100-203-d10 CT0258 *Homo sapiens* | 5.7 |
| 450313 | AI038989 | Hs. 24809 | hypothetical protein FLJ10826 | 5.7 |
| 416292 | AA179233 | Hs. 42390 | nasopharyngeal carcinoma susceptibility protein | 5.7 |
| 449309 | AW589823 | Hs. 224189 | ESTs | 5.7 |
| 408418 | AW963897 | Hs. 44743 | KIAA1435 protein | 5.7 |
| 416100 | H18700 | Hs. 268799 | ESTs | 5.7 |
| 437845 | AA769578 | Hs. 90488 | ESTs | 5.7 |
| 443345 | AI052508 | Hs. 164482 | "ESTs, Weakly similar to contains similarity to TPR domain | 5.7 |
| 418407 | AL044818 | Hs. 84928 | "nuclear transcription factor Y, beta" | 5.7 |
| 434557 | AW855466 | Hs. 271866 | "ESTs, Weakly similar to ALU1_HUMAN ALU SUBFAM | 5.7 |
| 431688 | AA513906 | | "gb: ng67c08.s1 NCI_CGAP_Lip2 *Homo sapiens* cDNA clo | 5.7 |
| 437641 | AA811452 | Hs. 291911 | ESTs | 5.7 |
| 409319 | AW752736 | Hs. 33565 | ESTs | 5.7 |
| 403967 | AF030107 | Hs. 17165 | regulator of G-protein signalling 13 | 5.7 |
| 445189 | AI936450 | Hs. 147482 | ESTs | 5.7 |
| 414418 | H62943 | Hs. 154188 | ESTs | 5.7 |
| 446563 | BE326588 | Hs. 141454 | ESTs | 5.7 |
| 446075 | AW451457 | Hs. 279179 | ESTs | 5.7 |
| 428068 | AW016437 | Hs. 233462 | ESTs | 5.7 |
| 438425 | AW292922 | Hs. 293170 | ESTs | 5.7 |
| 415532 | R14780 | Hs. 12826 | ESTs | 5.7 |
| 441442 | AL043282 | Hs. 131824 | ESTs | 5.7 |
| 443380 | AI792478 | Hs. 135377 | ESTs | 5.7 |
| 445527 | W39694 | Hs. 83286 | ESTs | 5.7 |
| 414376 | BE393856 | Hs. 66915 | "ESTs, Weakly similar to 16.7 Kd protein [*H. sapiens*]" | 5.7 |
| 457960 | AA771881 | Hs. 298149 | ESTs | 5.6 |
| 453293 | AA382267 | Hs. 10653 | ESTs | 5.6 |
| 452503 | AB000509 | Hs. 29736 | TNF receptor-associated factor 5 | 5.6 |
| 405227 | | | predicted exon | 5.6 |
| 442257 | AW503831 | | gb: UI-HF-BN0-alb-b-05-0-UI.r1 NIH_MGC_50 Homo sap | 5.6 |
| 403403 | | | predicted exon | 5.6 |
| 454377 | AA076811 | | gb: 7B03C12 Chromosome 7 Fetal Brain cDNA Library Hom | 5.6 |
| 438656 | H85310 | Hs. 209456 | "ESTs, Weakly similar to NG22 [*H. sapiens*]" | 5.6 |
| 419936 | AI792788 | | "gb: ol91d05.y5 NCI_CGAP_Kid5 *Homo sapiens* cDNA clo | 5.6 |
| 437267 | AW511443 | Hs. 258110 | ESTs | 5.6 |
| 430563 | AA481269 | Hs. 178381 | ESTs | 5.6 |
| 444835 | AI198994 | Hs. 158479 | ESTs | 5.6 |
| 444902 | AJ132099 | Hs. 12114 | vanin 1 | 5.6 |
| 451800 | AW977435 | Hs. 31890 | ESTs | 5.6 |

TABLE 1A-continued

ABOUT 1119 UP-REGULATED OVARIAN CANCER GENES

| Pkey | Ex Accn No | UG ID | Title | ratio |
|---|---|---|---|---|
| 405465 | | | predicted exon | 5.6 |
| 403891 | | | predicted exon | 5.6 |
| 425557 | AI694300 | Hs. 46730 | ESTs | 5.6 |
| 432162 | AA584062 | Hs. 272798 | hypothetical protein FLJ20413 | 5.6 |
| 450152 | AI138635 | Hs. 22968 | ESTs | 5.6 |
| 410053 | AW579707 | Hs. 59332 | ESTs | 5.6 |
| 421285 | NM_000102 | Hs. 1363 | "cytochrome P450, subfamily XVII (steroid 17-alpha-hydro | 5.6 |
| 425264 | AA353953 | Hs. 20369 | "ESTs, Weakly similar to gonadotropin inducible transcript | 5.6 |
| 418844 | M62982 | Hs. 1200 | arachidonate 12-lipoxygenase | 5.6 |
| 429616 | AI982722 | Hs. 120845 | ESTs | 5.6 |
| 423528 | AB011137 | Hs. 129740 | KIAA0565 gene product | 5.6 |
| 403089 | | | predicted exon | 5.6 |
| 414373 | AW162907 | Hs. 75969 | proline-rich protein with nuclear targeting signal | 5.6 |
| 403687 | | | predicted exon | 5.6 |
| 417079 | U65590 | Hs. 81134 | interleukin 1 receptor antagonist | 5.5 |
| 432501 | BE546532 | Hs. 287329 | Fas binding protein 1 | 5.5 |
| 403691 | | | predicted exon | 5.5 |
| 409545 | BE296182 | | "gb: 601177324F1 NIH_MGC_17 Homo sapiens cDNA clon | 5.5 |
| 435990 | AI015862 | Hs. 131793 | ESTs | 5.5 |
| 444409 | AI792140 | Hs. 49265 | ESTs | 5.5 |
| 435478 | AA682622 | | gb: zj20f09.s1 Soares_fetal_liver_spleen_1NFLS_S1 Homo | 5.5 |
| 439981 | AI348408 | Hs. 124675 | "ESTs, Weakly similar to unnamed protein product [H. sapie | 5.5 |
| 433644 | AW342028 | Hs. 256112 | ESTs | 5.5 |
| 441541 | AA938663 | Hs. 199828 | ESTs | 5.5 |
| 400709 | | | predicted exon | 5.5 |
| 407615 | AW753085 | | "gb: PM1-CT0247-151299-005-a03 CT0247 Homo sapiens | 5.5 |
| 424153 | AA451737 | Hs. 141496 | MAGE-like 2 | 5.5 |
| 452465 | AA610211 | Hs. 34244 | ESTs | 5.5 |
| 406030 | | | predicted exon | 5.5 |
| 431071 | AA491379 | | "gb: aa65f05 r1 NCI_CGAP_GCB1 Homo sapiens cDNA cl | 5.5 |
| 418086 | AA211791 | Hs. 269666 | "Homo sapiens cDNA FLJ13415 fis, clone PLACE1001799 | 5.5 |
| 453034 | BE246010 | Hs. 184109 | ribosomal protein L37a | 5.5 |
| 412953 | Z45794 | Hs. 238809 | ESTs | 5.5 |
| 425351 | AI206234 | Hs. 155924 | cAMP responsive element modulator | 5.5 |
| 406149 | | | predicted exon | 5.5 |
| 416533 | BE244053 | Hs. 79362 | retinoblastoma-like 2 (p130) | 5.5 |
| 458378 | AI040535 | Hs. 150524 | ESTs | 5.5 |
| 401213 | | | predicted exon | 5.5 |
| 405904 | | | predicted exon | 5.5 |
| 445132 | Z44811 | | gb: HSC29G031 normalized infant brain cDNA Homo sapie | 5.5 |
| 405138 | | | predicted exon | 5.5 |
| 442238 | AW135374 | Hs. 270949 | ESTs | 5.5 |
| 416852 | AF283776 | Hs. 80285 | Homo sapiens mRNA, cDNA DKFZp586C1723 (from clon | 5.5 |
| 448691 | AA481119 | Hs. 283558 | hypothetical protein PRO1855 | 5.5 |
| 452242 | R50956 | Hs. 59503 | "ESTs, Weakly similar to AF157318_1 AD-017 protein [H. s | 5.5 |
| 456994 | AA383623 | Hs. 293616 | ESTs | 5.5 |
| 440913 | AI267491 | Hs. 160593 | ESTs | 5.5 |
| 435380 | AA679001 | Hs. 192221 | ESTs | 5.5 |
| 450375 | AA009647 | Hs. 8850 | a disintegrin and metalloproteinase domain 12 (meltrin alph | 5.5 |
| 414035 | Y00630 | Hs. 75716 | "serine (or cysteine) proteinase inhibitor, clade B (ovalbumi | 5.4 |
| 459084 | H01699 | Hs. 27289 | CGI-125 protein | 5.4 |
| 405867 | | | predicted exon | 5.4 |
| 414093 | BE544867 | | "gb: 601078872F1 NIH_MGC_12 Homo sapiens cDNA clon | 5.4 |
| 447306 | AI373163 | Hs. 170333 | ESTs | 5.4 |
| 413083 | BE064528 | | "gb: RC4-BT0311-250200-014-h06 BT0311 Homo sapiens | 5.4 |
| 404828 | | | predicted exon | 5.4 |
| 402543 | | | predicted exon | 5.4 |
| 421988 | AW450481 | Hs. 161333 | ESTs | 5.4 |
| 413404 | BE503463 | Hs. 297431 | ESTs | 5.4 |
| 459043 | AI806444 | Hs. 208113 | "ESTs, Weakly similar to N-WASP [H. sapiens]" | 5.4 |
| 404410 | | | predicted exon | 5.4 |
| 430264 | AA470519 | | "gb: nc71f10.s1 NCI_CGAP_Pr1 Homo sapiens cDNA clon | 5.4 |
| 431499 | NM_001514 | Hs. 258561 | general transcription factor IIB | 5.4 |
| 412566 | AW962574 | | "gb: EST374647 MAGE resequences, MAGG Homo sapien | 5.4 |
| 454239 | BE176420 | Hs. 8177 | ESTs | 5.4 |
| 458163 | AA884304 | Hs. 131163 | ESTs | 5.4 |
| 446205 | AW172662 | Hs. 149479 | ESTs | 5.4 |
| 455275 | AW977806 | | "gb: EST389810 MAGE resequences, MAGO Homo sapien | 5.4 |
| 415579 | AA165232 | Hs. 222069 | ESTs | 5.4 |
| 423200 | AA323073 | Hs. 289083 | ESTs | 5.4 |
| 440052 | AI633744 | Hs. 195648 | ESTs | 5.4 |
| 424717 | H03754 | Hs. 152213 | "wingless-type MMTV integration site family, member 5A" | 5.4 |
| 420111 | AA255652 | | gb: zs21h11.r1 NCI_CGAP_GCB1 Homo sapiens cDNA clo | 5.4 |
| 432140 | AK000404 | Hs. 272688 | hypothetical protein FLJ20397 | 5.4 |
| 414904 | AA157881 | Hs. 143056 | ESTs | 5.4 |

TABLE 1A-continued

ABOUT 1119 UP-REGULATED OVARIAN CANCER GENES

| Pkey | Ex Accn No | UG ID | Title | ratio |
| --- | --- | --- | --- | --- |
| 409479 | BE163800 | Hs. 136912 | ESTs | 5.4 |
| 404727 | | | predicted exon | 5.4 |
| 446011 | AI623778 | Hs. 145809 | ESTs | 5.4 |
| 456083 | U46922 | Hs. 77252 | fragile histidine triad gene | 5.4 |
| 424834 | AK001432 | Hs. 153408 | "Homo sapiens cDNA FLJ10570 fis, clone NT2RP2003117 | 5.4 |
| 425071 | NM_013989 | Hs. 154424 | "deiodinase, iodothyronine, type II" | 5.4 |
| 426065 | N32049 | | gb: yw96g08 s1 Soares_placenta_8to9weeks_2NbHP8to9W | 5.4 |
| 415602 | F12920 | Hs. 165575 | ESTs | 5.4 |
| 432839 | AA579465 | Hs. 287332 | ESTs | 5.4 |
| 416879 | H98899 | Hs. 42599 | ESTs | 5.4 |
| 456088 | BE177320 | Hs. 156148 | "Homo sapiens cDNA FLJ23082 fis, clone LNG06451" | 5.4 |
| 423175 | W27595 | Hs. 18653 | ESTs | 5.4 |
| 424585 | AA464840 | | gb: zx43h11 r1 Soares_total_fetus_Nb2HF8_9w Homo sapie | 5.3 |
| 452281 | T93500 | Hs. 28792 | "Homo sapiens cDNA FLJ11041 fis, clone PLACE1004405 | 5.3 |
| 424323 | AA338791 | Hs. 146763 | nascent-polypeptide-associated complex alpha polypeptide | 5.3 |
| 426701 | AI968103 | Hs. 209461 | "Homo sapiens cDNA FLJ12836 fis, clone NT2RP2003206 | 5.3 |
| 447645 | AW897321 | Hs. 159699 | ESTs | 5.3 |
| 402974 | | | predicted exon | 5.3 |
| 436607 | AW661783 | Hs. 211061 | ESTs | 5.3 |
| 428873 | AI701609 | Hs. 98908 | ESTs | 5.3 |
| 405454 | | | predicted exon | 5.3 |
| 431867 | AA523660 | Hs. 191727 | ESTs | 5.3 |
| 442768 | AL048534 | Hs. 48458 | "ESTs, Weakly similar to ALU8_HUMAN ALU SUBFAM | 5.3 |
| 424085 | NM_002914 | Hs. 139226 | replication factor C (activator 1) 2 (40 kD) | 5.3 |
| 435098 | AF174394 | Hs. 177461 | "Homo sapiens apoptotic-related protein PCAR mRNA, par | 5.3 |
| 421284 | U62435 | Hs. 103128 | "cholinergic receptor, nicotinic, alpha polypeptide 6" | 5.3 |
| 435711 | AF226667 | Hs. 58553 | CTP synthase II | 5.3 |
| 405292 | | | predicted exon | 5.3 |
| 410123 | T16981 | Hs. 21963 | ESTs | 5.3 |
| 435435 | T89473 | Hs. 192328 | ESTs | 5.3 |
| 417071 | N58820 | Hs. 275133 | ESTs | 5.3 |
| 438958 | H50167 | Hs. 33113 | ESTs | 5.3 |
| 457405 | AA504860 | | gb: ab03a10.s1 Stratagene fetal retina 937202 Homo sapiens | 5.3 |
| 413642 | BE154837 | | "gb: PM1-HT0345-121199-001-c08 HT0345 Homo sapiens | 5.3 |
| 433868 | AA612960 | | gb: nq38g06.s1 NCI_CGAP_Co10 Homo sapiens cDNA clo | 5.3 |
| 444461 | R53734 | Hs. 25978 | ESTs | 5.3 |
| 427088 | AA398085 | Hs. 142390 | ESTs | 5.3 |
| 451307 | AW293207 | Hs. 211516 | ESTs | 5.3 |
| 403831 | | | predicted exon | 5.3 |
| 402892 | | | predicted exon | 5.3 |
| 433420 | AI674093 | Hs. 293961 | ESTs | 5.3 |
| 455759 | BE080469 | | "gb: QV1-BT0630-280200-086-d06 BT0630 Homo sapiens | 5.3 |
| 411379 | AI816344 | Hs. 12554 | "ESTs, Weakly similar to Nucleosome Assembly Protein 1- | 5.3 |
| 428483 | AI908539 | Hs. 184592 | KIAA0344 gene product | 5.3 |
| 429208 | AA447990 | Hs. 190478 | ESTs | 5.3 |
| 447572 | AI631546 | Hs. 159732 | ESTs | 5.3 |
| 434896 | AW022054 | Hs. 136591 | ESTs | 5.3 |
| 417616 | R07728 | Hs. 268668 | ESTs | 5.3 |
| 411805 | AW864183 | | "gb: PM0-SN0014-260400-002-d02 SN0014 Homo sapiens | 5.3 |
| 419000 | T79855 | Hs. 268592 | ESTs | 5.3 |
| 413488 | BE144017 | Hs. 184693 | "transcription elongation factor B (SIII), polypeptide 1 (15 k | 5.3 |
| 400975 | | | predicted exon | 5.3 |
| 407453 | AJ132087 | | gb: Homo sapiens mRNA for axonemal dynein heavy chain ( | 5.3 |
| 430757 | AI458623 | | "gb: tk04g09.x1 NCI_CGAP_Lu24 Homo sapiens cDNA clo | 5.3 |
| 417793 | AW405434 | Hs. 82575 | small nuclear ribonucleoprotein polypeptide B" | 5.2 |
| 401877 | AB011094 | Hs. 129892 | KIAA0522 protein | 5.2 |
| 457122 | AI026157 | Hs. 33728 | "ESTs, Weakly similar to ALU1_HUMAN ALU SUBFAM | 5.2 |
| 410706 | AI732404 | Hs. 68846 | ESTs | 5.2 |
| 435807 | AI033299 | Hs. 113614 | ESTs | 5.2 |
| 428398 | AI249368 | Hs. 98558 | ESTs | 5.2 |
| 401088 | | | predicted exon | 5.2 |
| 414501 | N43991 | Hs. 171984 | ESTs | 5.2 |
| 419083 | AI479560 | Hs. 98613 | "Homo sapiens cDNA FLJ12292 fis, clone MAMMA10018 | 5.2 |
| 421107 | AA283822 | Hs. 55606 | "ESTs, Weakly similar to ZN91_HUMAN ZINC FINGER P | 5.2 |
| 411489 | AW848346 | | "gb: IL3-CT0214-150200-076-F03 CT0214 Homo sapiens c | 5.2 |
| 419307 | X14767 | Hs. 89768 | "gamma-aminobutyric acid (GABA) A receptor, beta 1" | 5.2 |
| 430082 | AW514083 | Hs. 190135 | ESTs | 5.2 |
| 425698 | NM_016112 | Hs. 159241 | polycystic kidney disease 2-like 1 | 5.2 |
| 451686 | AA059246 | Hs. 110293 | ESTs | 5.2 |
| 453867 | AI929383 | Hs. 108196 | HSPC037 protein | 5.2 |
| 419985 | H66373 | Hs. 15973 | "ESTs, Highly similar to bA393J16 3 [H. sapiens]" | 5.2 |
| 426650 | AA382814 | | "gb: EST96097 Testis I Homo sapiens cDNA 5' end, mRNA | 5.2 |
| 424115 | AA335497 | Hs. 293965 | ESTs | 5.2 |
| 405576 | | | predicted exon | 5.2 |
| 409584 | AA076010 | | gb: zm89f12 s1 Stratagene ovarian cancer (937219) Homo sa | 5.2 |

TABLE 1A-continued

ABOUT 1119 UP-REGULATED OVARIAN CANCER GENES

| Pkey | Ex Accn No | UG ID | Title | ratio |
|---|---|---|---|---|
| 454423 | AW603985 | Hs. 179662 | nucleosome assembly protein 1-like 1 | 5.2 |
| 417173 | U61397 | Hs. 81424 | ubiquitin-like 1 (sentrin) | 5.2 |
| 439155 | H81076 | Hs. 269001 | ESTs | 5.2 |
| 432267 | AK000872 | Hs. 274227 | "*Homo sapiens* cDNA FLJ10010 fis, clone HEMBA100030 | 5.2 |
| 459024 | AA020799 | Hs. 179825 | RAN binding protein 2-like 1 | 5.2 |
| 404088 | | | predicted exon | 5.2 |
| 403525 | | | predicted exon | 5.2 |
| 445882 | AI948717 | Hs. 225155 | "ESTs, Weakly similar to PSF_HUMAN PTB-ASSOCIATE | 5.2 |
| 448257 | AW772070 | Hs. 253146 | ESTs | 5.2 |
| 410500 | R09442 | | gb: yf26c09.r1 Soares fetal liver spleen 1NFLS Homo sapien | 5.2 |
| 456084 | AA155859 | Hs. 79708 | ESTs | 5.2 |
| 410523 | BE143839 | | "gb: MR0-HT0164-151299-012-d03 HT0164 *Homo sapiens* | 5.2 |
| 434623 | AB023163 | Hs. 4014 | KIAA0946 protein; Huntingtin interacting protein H. | 5.2 |
| 454484 | AW795196 | Hs. 215857 | nng finger protein 14 | 5.2 |
| 402131 | | | predicted exon | 5.2 |
| 438913 | AI380429 | Hs. 172445 | ESTs | 5.2 |
| 402628 | | | predicted exon | 5.1 |
| 415973 | R24707 | Hs. 260201 | ESTs | 5.1 |
| 455640 | BE064059 | | "gb: QV3-BT0296-010300-111-e04 BT0296 *Homo sapiens* | 5.1 |
| 442750 | AI016803 | Hs. 131096 | ESTs | 5.1 |
| 404638 | | | predicted exon | 5.1 |
| 431117 | AF003522 | Hs. 250500 | delta (Drosophila)-like 1 | 5.1 |
| 428819 | AL135623 | Hs. 193914 | KIAA0575 gene product | 5.1 |
| 439519 | AA837118 | Hs. 118366 | ESTs | 5.1 |
| 427335 | AA448542 | Hs. 251677 | G antigen 7B | 5.1 |
| 416450 | AA180467 | Hs. 142556 | ESTs | 5.1 |
| 440876 | AW613524 | Hs. 279570 | ESTs | 5.1 |
| 414584 | BE409585 | | "gb: 601301836F1 NIH_MGC_21 *Homo sapiens* cDNA clon | 5.1 |
| 443175 | N57863 | | gb: yv60c02 s1 Soares fetal liver spleen 1NFLS Homo sapie | 5.1 |
| 408968 | AI652236 | Hs. 49376 | hypothetical protein FLJ20644 | 5.1 |
| 415654 | AW968363 | | "gb: EST380439 MAGE resequences, MAGJ *Homo sapiens* | 5.1 |
| 440559 | AW629054 | Hs. 125976 | ESTs, Weakly similar to metalloprotease/disintegrin/cystei | 5.1 |
| 421236 | AI287622 | Hs. 151956 | ESTs | 5.1 |
| 416258 | N45661 | Hs. 275131 | ESTs | 5.1 |
| 405982 | | | predicted exon | 5.1 |
| 406589 | | | predicted exon | 5.1 |
| 412458 | AW953229 | Hs. 169142 | ESTs | 5.1 |
| 435693 | AI033134 | Hs. 119887 | ESTs | 5.1 |
| 449182 | AW292381 | Hs. 224150 | ESTs | 5.1 |
| 403963 | | | predicted exon | 5.1 |
| 440830 | AI733112 | Hs. 176101 | ESTs | 5.1 |
| 415412 | F08049 | Hs. 52132 | ESTs | 5.1 |
| 442832 | AW206560 | Hs. 253569 | ESTs | 5.1 |
| 445359 | AI808725 | Hs. 147783 | ESTs | 5.1 |
| 412088 | AI689496 | Hs. 108932 | ESTs | 5.1 |
| 428785 | AI015953 | Hs. 125265 | ESTs | 5.1 |
| 430163 | X66610 | Hs. 234748 | "enolase alpha, lung-specific" | 5.1 |
| 455441 | AW945964 | | "gb: QV0-ET0001-050500-228-e09 ET0001 *Homo sapiens* c | 5.1 |
| 400304 | AF005082 | Hs. 113261 | "*Homo sapiens* skin-specific protein (xp33) mRNA, partial | 5.1 |
| 403944 | | | predicted exon | 5.1 |
| 457069 | BE159191 | Hs. 114318 | "ESTs, Weakly similar to ORF1 [*H. sapiens*]" | 5.1 |
| 414125 | BE253197 | | "gb: 601116804F1 NIH_MGC_16 *Homo sapiens* cDNA clon | 5.1 |
| 448566 | AW291319 | Hs. 194574 | ESTs | 5.1 |
| 457948 | AI498640 | Hs. 159354 | ESTs | 5.1 |
| 438240 | N92638 | Hs. 124004 | ESTs | 5.1 |
| 404070 | | | predicted exon | 5.1 |
| 402709 | | | predicted exon | 5.1 |
| 416425 | BE077308 | | "gb: RC1-BT0606-060200-012-h12 BT0606 *Homo sapiens* | 5.0 |
| 407173 | T64349 | | gb: yc10d08 s1 Stratagene lung (937210) *Homo sapiens* cDN | 5.0 |
| 452502 | AI904296 | | "gb: PM-BT046-220199-286_1 BT046 *Homo sapiens* cDNA | 5.0 |
| 446657 | AI335191 | Hs. 260702 | "ESTs, Moderately similar to ALU7_HUMAN ALU SUBF | 5.0 |
| 459124 | AW301478 | Hs. 299178 | ESTs | 5.0 |
| 409940 | BE548143 | | "gb: 601073109F1 NIH_MGC_12 *Homo sapiens* cDNA clon | 5.0 |
| 443547 | AW271273 | Hs. 23767 | "*Homo sapiens* cDNA FLJ12666 fis, clone NT2RM400225 | 5.0 |
| 447452 | BE618258 | Hs. 102480 | ESTs | 5.0 |
| 414327 | BE408145 | Hs. 185254 | "ESTs, Moderately similar to NAC-1 protein [*R.norvegicus*] | 5.0 |
| 416155 | AI807264 | Hs. 205442 | "ESTs, Weakly similar to AF117610_1 inner centromere pro | 5.0 |
| 408081 | AW451597 | Hs. 167409 | ESTs | 5.0 |
| 426834 | AI091533 | Hs. 135167 | ESTs | 5.0 |
| 433368 | AW877277 | | "gb: MR4-PT0051-150200-001-d03 PT0051 *Homo sapiens* | 5.0 |
| 433098 | AW190593 | Hs. 151143 | ESTs | 5.0 |
| 439721 | W92142 | Hs. 271963 | "ESTs, Weakly similar to ALU5_HUMAN ALU SUBFAM | 5.0 |
| 441818 | AI630451 | Hs. 7976 | KIAA0332 protein | 5.0 |
| 458804 | AL157625 | | gb: DKFZp761L2016_r1 761 (synonym hamy2) Homo sapi | 5.0 |
| 411905 | BE265067 | | "gb: 601193893F1 NIH_MGC_7 *Homo sapiens* cDNA clone | 5.0 |

TABLE 1A-continued

ABOUT 1119 UP-REGULATED OVARIAN CANCER GENES

| Pkey | Ex Accn No | UG ID | Title | ratio |
|---|---|---|---|---|
| 434248 | AA628151 | Hs. 187783 | ESTs | 5.0 |
| 423967 | AW296756 | Hs. 11641 | "*Homo sapiens* cDNA FLJ21432 fis, clone COL04219" | 5.0 |
| 456212 | N51636 | | gb: yy87b01.s1 Soares_multiple_sclerosis_2NbHMSP Homo | 5.0 |
| 442914 | AW188551 | Hs. 99519 | "*Homo sapiens* cDNA FLJ14007 fis, clone Y79AA1002407 | 5.0 |
| 436084 | AK000185 | | "gb: *Homo sapiens* cDNA FLJ20178 fis, clone COL09990" | 5.0 |
| 449252 | AW594482 | Hs. 253315 | ESTs | 5.0 |
| 454653 | AW812227 | | "gb: RC2-ST0173-201099-011-g09 ST0173 *Homo sapiens* c | 5.0 |
| 414699 | AI815523 | Hs. 76930 | "synuclein, alpha (non A4 component of amyloid precursor) | 5.0 |
| 443335 | T89697 | Hs. 16645 | ESTs | 5.0 |
| 448419 | AL080072 | Hs. 21195 | *Homo sapiens* mRNA; cDNA DKFZp564M0616 (from clon | 5.0 |
| 425574 | AA359663 | | "gb: EST68717 Fetal lung II *Homo sapiens* cDNA 5' end, mR | 5.0 |
| 435174 | AA687378 | Hs. 194624 | ESTs | 5.0 |
| 429548 | AW138872 | Hs. 135288 | ESTs | 5.0 |
| 450613 | AI702055 | | "gb: tq20g10.x1 NCI_CGAP_Ut1 *Homo sapiens* cDNA clon | 5.0 |
| 400432 | AX015809 | Hs. 287767 | Sequence 8 from Patent WO9950285 | 5.0 |
| 421751 | AW813731 | Hs. 159153 | ESTs | 5.0 |
| 405800 | | | predicted exon | 5.0 |
| 429430 | AI381837 | Hs. 155335 | ESTs | 5.0 |
| 439518 | W76326 | | gb: zd60d04.r1 Soares_fetal_heart_NbHH19W Homo sapien | 5.0 |
| 430884 | AF053748 | Hs. 248114 | glial cell derived neurotrophic factor | 5.0 |
| 452741 | BE392914 | Hs. 30503 | "*Homo sapiens* cDNA FLJ11344 fis, clone PLACE1010870 | 5.0 |
| 441001 | AW137017 | Hs. 126373 | Human DNA sequence from clone RP5-1184F4 on chromos | 5.0 |
| 438490 | AW593272 | Hs. 26261 | ESTs | 5.0 |
| 408170 | AW204516 | Hs. 31835 | ESTs | 5.0 |
| 449104 | R08702 | | gb: yf24c06.r1 Soares fetal liver spleen 1NFLS Homo sapien | 5.0 |

Pkey: Primekey
Ex. Accn No: Exemplar Accession
UG ID: Unigene ID
Title: UG title
ratio: ration tumor vs. normal tissues
In Pkey 436513, DEAD (Asp-Glu-Ala-Asp) in DEAD-box protein = SEQ ID NO:162.

TABLE 1B

| Pkey | CAT Number | Accession |
|---|---|---|
| 407615 | 1005404_1 | AW753085 AW753082 AW054744 AW753107 AW753087 |
| 408391 | 1055687_1 | AW859276 AW859274 AW190959 T91463 |
| 408523 | 1063925_1 | AW833259 AW833273 AW206846 |
| 408914 | 1089828_1 | AW450309 |
| 408987 | 109306_1 | H85615 H86300 H86263 H86282 AA059278 H86304 |
| 409191 | 1107176_1 | AW818390 AW818237 AW858911 AW858977 BE072544 W26498 |
| 409545 | 1138823_1 | BE296182 AW629821 |
| 409584 | 114165_1 | AA076010 AA076009 AI094314 |
| 409695 | 114876_1 | AA296961 AA296889 AA076945 AA077528 AA077497 |
| 409866 | 1156522_1 | AW502152 H41202 H29772 |
| 409867 | 1156530_1 | AW502161 AW502587 AW502345 |
| 409940 | 1160994_1 | BE548143 AW511659 |
| 409982 | 1165022_1 | BE005839 BE005619 AW516815 |
| 410500 | 1206323_1 | R09442 AW846115 AW846108 AW751967 AW846083 AW846087 AW846090 |
| 410523 | 1207041_1 | BE143839 AW752787 AW752795 BE143584 N71805 |
| 410536 | 1207322_1 | N39533 AW753094 AW753093 |
| 410626 | 1212621_-1 | BE407727 |
| 410966 | 1228071_1 | AW812088 AW812105 AW812082 |
| 411004 | 1228975_1 | AW813242 BE146089 AW813195 AW813173 AW813206 BE145953 BE146212 AW813196 AW854582 AW813241 BE061582 |
| 411018 | 1229132_1 | AW813428 AW813444 AW813367 AW813368 AW813429 AW813424 |
| 411057 | 1230493_1 | AW815098 BE154843 BE154831 |
| 411178 | 1234752_1 | AW820852 AW820773 AW821088 |
| 411237 | 1236377_1 | AW833676 AW833814 AW833798 AW833677 AW833449 AW833630 AW833626 AW833444 AW833366 AW833791 AW833659 AW833432 AW833534 AW833556 AW833553 |
| 411483 | 1247172_1 | AW848115 AW848127 AW887028 AW887117 |
| 411489 | 1247360_1 | AW848346 AW848760 AW848340 AW848818 AW849043 AW849061 |
| 411541 | 1249044_1 | W03940 T98335 AW850705 |
| 411660 | 1253078_1 | AW855718 AW855740 AW855748 |
| 411693 | 1254206_1 | AW857271 AW857308 AW857296 AW857258 |
| 411722 | 1254914_1 | AW875942 AW858234 AW875938 AW875941 AW858235 AW875958 |
| 411725 | 1255047_1 | AW858396 AW858505 AW858476 AW861971 AW858556 AW861908 AW858514 AW858601 AW861909 AW858434 AW858400 AW858405 AW858393 |
| 411748 | 1256178_1 | AW859920 BE079582 AW997112 |
| 411805 | 1259273_1 | AW864183 AW864181 AW864135 AW864198 |
| 411905 | 1265181_1 | BE265067 BE264978 AW875420 |

TABLE 1B-continued

| Pkey | CAT Number | Accession |
|---|---|---|
| 411940 | 1266262__1 | AW876686 AW876717 AW877215 AW876691 AW876722 AW877218 AW876694 AW876725 |
| 412167 | 1280605__1 | AW897230 AW897252 AW897244 AW897231 AW897263 |
| 412333 | 1289037__1 | AW937485 AW937589 AW937658 AW937654 AW937492 |
| 412402 | 1292917__1 | AW984788 AW984816 AW984811 AW984807 AW984819 AW984790 AW984782 AW984784 AW984780 AW984814 AW984795 AW984793 AW984789 AW984823 AW948021 AW984802 AW984800 AW984799 AW984825 AW984792 AW984821 AW984820 AW984808 AW984809 AW984812 AW984801 AW984813 AW984778 AW984804 AW984798 AW948017 AW984827 |
| 412566 | 1306469__1 | AW962574 BE073261 |
| 412670 | 131990__1 | AA115456 AW978117 AA814593 |
| 412740 | 1324538__1 | AW993984 AW994001 AW994002 |
| 412761 | 1325424__1 | AW995092 AW995095 AW995103 |
| 413083 | 1348639__1 | BE064528 BE064589 BE064561 |
| 413101 | 1349154__1 | BE065215 BE155544 BE155541 BE155540 BE155542 BE155543 |
| 413252 | 1355877__1 | BE074910 BE074913 BE074911 BE074903 BE074892 BE074935 |
| 413382 | 1365954__1 | BE090689 BE090685 BE090697 BE090680 BE090691 BE090696 BE090698 BE090686 |
| 413425 | 136885__1 | F20956 AA129374 AA133740 AW819878 |
| 413470 | 1371600__1 | N20934 BE141875 BE141877 |
| 413521 | 1374612__1 | BE145814 BE145830 BE145884 BE145823 BE145905 BE145883 BE145833 BE145889 BE145834 |
| 413544 | 1375671__1 | BE147225 BE147205 BE147234 |
| 413642 | 1381386__1 | BE154837 BE154879 BE154850 BE154877 BE154835 BE154849 BE154902 BE154905 BE154867 BE154901 BE154904 BE154899 |
| 413702 | 1383899__1 | BE170313 BE158339 BE158290 |
| 413864 | 1395788__1 | BE175582 BE175514 BE175505 BE175591 BE175530 |
| 414093 | 1416417__1 | BE544867 BE247720 |
| 414125 | 1419230__1 | BE253197 BE259456 BE254462 |
| 414195 | 1424854__-3 | BE263293 |
| 414210 | 1426051__1 | BE383592 BE261671 |
| 414266 | 1430984__1 | BE267834 BE514180 BE514096 |
| 414315 | 143512__1 | Z24878 AA494098 F13654 AA494040 AA143127 |
| 414539 | 1460320__1 | BE379046 BE395459 |
| 414540 | 1460324__-1 | BE379050 |
| 414584 | 1464068__-1 | BE409585 |
| 414605 | 1465790__-1 | BE390440 |
| 414606 | 1465801__1 | BE387771 BE387954 BE389705 |
| 414808 | 1492624__1 | T95945 R98276 BE539541 |
| 414954 | 1509857__1 | D81402 C15494 D61078 D61313 D80399 D81520 |
| 414995 | 1511736__1 | C18200 D78681 T82025 |
| 415613 | 1540602__1 | R20233 F12901 T74740 |
| 415654 | 154135__1 | AW968363 AA465492 R34539 AA165411 |
| 415715 | 1548818__1 | F30364 F36559 T15435 |
| 415747 | 155189__1 | AA381209 AA381245 AA167683 |
| 416151 | 1573926__1 | T26661 Z44135 H23016 |
| 416168 | 1574545__1 | H23687 H46460 H40239 |
| 416425 | 159388__1 | BE077308 AL043350 AW962170 AA180251 AA325287 |
| 416441 | 159480__1 | BE407197 AA182474 AA180369 BE275628 BE276131 |
| 416548 | 1600181__1 | H62953 N76608 N72413 |
| 416665 | 1607797__1 | H72974 W28967 |
| 416913 | 163001__1 | AW934714 BE161007 BE162500 AW749902 AW749864 BE162498 BE161005 AA190449 AW513465 BE161006 BE162499 |
| 417344 | 166827__1 | AW997313 AA195805 |
| 417549 | 168700__1 | AA203651 R89136 |
| 417611 | 168900__1 | AW993983 AW994798 AW993990 AW993999 AW993989 AA204755 |
| 417682 | 1692759__1 | W69561 R08486 R87183 |
| 418636 | 177402__1 | AW749855 AA225995 AW750208 AW750206 |
| 418709 | 178363__1 | AA227394 AA641866 AW750732 |
| 419753 | 187763__1 | N42531 W25700 AA249574 AA569553 |
| 419936 | 189181__1 | AI792788 BE142230 AA252019 |
| 420111 | 190755__1 | AA255652 AA280911 AW967920 AA262684 |
| 422949 | 223184__1 | AA319435 N56456 AA319377 AW961532 T48452 AA894424 |
| 423735 | 231498__1 | AA330259 AA661806 AA502431 AW974633 AA649496 |
| 423756 | 231725__1 | AA828125 AA834883 AA330555 |
| 423843 | 232510__1 | AA332652 AA331633 AW999369 AW902993 BE170475 AA378845 AW964175 AI475221 |
| 424101 | 235398__1 | AA335394 AA335535 AA335244 AW966148 |
| 424324 | 238127__1 | AA346316 BE160193 AA338802 AW954536 |
| 424585 | 241151__1 | AA464840 AA343628 |
| 424872 | 244505__1 | AA347923 AA347928 AW961769 |
| 425090 | 246649__1 | AA350552 R21667 AW953258 |
| 425574 | 253317__1 | AA359663 AA359654 AW963124 |
| 425612 | 253969__1 | BE004257 AW811190 AA360576 BE172402 BE181703 |
| 426065 | 260276__1 | N32049 R34821 R78237 |
| 426130 | 261414__1 | AA853282 BE255688 AA370481 |
| 426544 | 268987__1 | AA492325 AA503675 AA381181 |
| 426650 | 270283__1 | AA382814 AA402411 AA412355 |
| 429163 | 300543__1 | AA884766 AW974271 AA592975 AA447312 |
| 430264 | 315008__1 | AA470519 BE303010 BE302954 BE384120 |
| 430757 | 322947__1 | AI458623 AA639708 AA485409 R22065 AA485570 |
| 431071 | 327550__1 | AA491379 H86020 AW969148 |

TABLE 1B-continued

| Pkey | CAT Number | Accession |
|---|---|---|
| 431688 | 336609_1 | AA513906 AA847734 AI357044 |
| 431822 | 338082_1 | AA516049 AW004922 |
| 432189 | 342819_1 | AA527941 AI810608 AI620190 AA635266 |
| 432340 | 345248_1 | AA534222 AA632632 T81234 |
| 432363 | 345469_1 | AA534489 AW970240 AW970323 |
| 432966 | 356839_1 | AA650114 AW974148 AA572946 |
| 433368 | 364276_1 | AW877277 AW811294 |
| 433449 | 366532_1 | AW772282 AA592974 |
| 433868 | 375629_1 | AA612960 AI934769 T12348 |
| 434098 | 380006_1 | AA625499 AA625269 AA625184 |
| 434374 | 384889_1 | AA631439 AI086355 AI082577 |
| 434804 | 393481_1 | AA649530 AA659316 H464973 |
| 434950 | 396061_1 | AW974892 AA654375 |
| 435478 | 406683_1 | AA682622 BE141696 |
| 436084 | 41437_1 | AK000185 AW841262 |
| 436532 | 421802_1 | AA721522 AW975443 T93070 |
| 436843 | 427748_1 | AA824588 AA732269 AW977148 |
| 437096 | 433006_1 | AA744406 AA745347 AA745535 |
| 437146 | 43371_1 | AA730977 AI261584 AA334473 Z43283 AW875861 AW938044 BE150701 AW936262 AA306862 BE565575 BE567380 AA728920 AA167612 AI239729 AI251752 AA485791 BE568425 AW962958 |
| 437152 | 43386_1 | AL050027 BE089051 |
| 437229 | 434947_1 | AW976005 AW419264 AA747275 AA810377 |
| 439031 | 46798_1 | AF075079 H48601 H48795 |
| 439152 | 46920_1 | H65014 AF086007 H65015 |
| 439518 | 47334_1 | W76326 AF086341 W72300 |
| 440051 | 48426_2 | BE559980 BE397203 BE268207 BE559764 BE267725 BE513654 BE267742 BE268219 BE267665 BE561356 |
| 441194 | 51193_1 | BE274581 BE275382 AA703515 BE166690 |
| 441369 | 515636_1 | AA931535 AI458601 Z44913 |
| 442257 | 53699_1 | AW503831 AW503317 BE565665 |
| 443161 | 561305_1 | AI038316 AI344631 AI261653 |
| 443175 | 561882_1 | N57863 AI038952 W90167 N64103 |
| 443198 | 562655_1 | AI039813 AI684642 Z40121 AI951414 BE501049 |
| 443534 | 572957_1 | AI076123 AI244834 AI695239 |
| 443613 | 575391_1 | AI079356 W23287 |
| 443657 | 576685_1 | R14973 R14967 AI081006 |
| 443747 | 57918_1 | AV646352 AV652121 AV652008 |
| 443860 | 583216_1 | AW866632 AI089351 D61942 |
| 445132 | 63111_1 | Z44811 R13709 AV652749 AW814906 AA084016 |
| 445153 | 631644_1 | AI214671 Z45244 H24136 R25934 |
| 445232 | 633433_1 | BE294357 N36568 AI217006 |
| 446171 | 664826_1 | AI374927 AI278380 AI301383 |
| 447252 | 714160_1 | R90916 AL120023 R18429 Z42095 AI369730 R90824 |
| 448516 | 766241_1 | AW898595 AW898588 AW898663 AW898592 AI525093 |
| 449104 | 798149_1 | R08702 R09864 AI630313 |
| 450613 | 840016_1 | AI702055 R89204 R86260 |
| 452077 | 897051_1 | BE144949 BE144991 BE144990 AI832199 |
| 452502 | 919733_1 | AI904296 BE007223 R30687 |
| 452507 | 919998_1 | AI904646 BE179494 BE179421 |
| 452542 | 921410_1 | AW812256 AW812257 AI906423 AI906422 |
| 452563 | 922265_1 | AI907552 C03707 C02870 |
| 452947 | 939810_1 | AW130413 AI932362 |
| 453509 | 969632_1 | AL040021 AL040037 |
| 453845 | 983027_1 | AL157568 |
| 454182 | 1049569_1 | AW177335 AW177352 AW177340 AW177378 AW177339 AW177388 AW177393 |
| 454377 | 114761_1 | AA076811 AW814764 |
| 454389 | 115682_1 | AW752571 AW847602 AA077979 |
| 454455 | 1206965_1 | AW752710 BE180336 BE180186 |
| 454505 | 1219564_1 | AW801365 AW801435 AW801372 |
| 454556 | 1223878_1 | AW807073 AW807055 AW807067 AW807276 AW807030 AW807363 AW845892 AW807091 AW807275 AW807284 AW807287 AW807195 AW807271 |
| 454574 | 1225636_1 | AW809109 AW809112 AW809122 AW809126 AW809128 AW809133 AW809131 AW809113 AW809111 AW809132 |
| 454597 | 1226059_1 | AW809648 AW809704 AW809643 AW809653 AW809709 AW809949 AW809939 AW810010 AW809705 AW809950 AW809822 AW809667 AW810093 AW810076 AW809673 AA810349 AW809895 |
| 454633 | 1227504_1 | AW811380 AW811385 |
| 454653 | 1228081_1 | AW812227 AW812294 AW812092 |
| 454690 | 1229106_1 | AW854639 AW854719 AW854718 BE145880 AW854692 BE145866 AW816154 AW854698 AW854654 AW813335 AW854699 |
| 454707 | 1230250_1 | AW814989 AW814852 AW814808 |
| 454822 | 1236369_1 | AW833793 AW833799 AW833346 AW833371 AW833795 AW833562 AW833667 AW833377 |
| 454874 | 1238494_1 | AW836407 BE175600 BE175579 |
| 454913 | 1242238_1 | AW841462 BE156657 BE156668 BE092475 |
| 454934 | 1245577_1 | AW846080 AW846074 AW846118 AW846130 |
| 454963 | 1246752_1 | AW847647 AW847659 AW847656 AW847653 AW847717 AW847786 |
| 455013 | 1248899_1 | BE073250 BE073378 BE073379 AW850533 AW850529 |
| 455092 | 1252971_1 | BE152428 AW855572 AW855607 |
| 455110 | 1253955_1 | BE154505 BE154462 BE154454 BE154460 BE154489 BE154496 AW856909 BE154497 BE154565 BE154572 BE154500 BE154472 |

TABLE 1B-continued

| Pkey | CAT Number | Accession |
|---|---|---|
| 455121 | 1254339_1 | BE156459 BE156469 BE156468 AW857447 |
| 455152 | 1255227_1 | AW858621 AW937120 |
| 455203 | 1259973_1 | AW865450 AW865119 AW865452 AW865461 AW865325 AW865114 AW865116 AW865321 AW865590 AW865390 |
| 455275 | 1272255_1 | AW977806 AW887923 AW886321 |
| 455435 | 1290546_1 | AW939445 AW939465 AW939604 AW939531 AW939530 AW939993 |
| 455441 | 1291505_1 | AW945964 AW946020 AW946034 AW946027 AW946041 AW946044 AW946033 AW946024 AW946021 AW946029 AW946015 AW946016 AW946039 AW946045 AW946028 AW946036 |
| 455592 | 1335196_1 | BE008002 BE007997 BE007998 BE008000 |
| 455640 | 1348141_1 | BE064059 BE063903 BE063838 BE063863 BE064056 BE063974 BE063904 BE063898 BE063896 BE063906 BE063980 BE065387 BE065310 BE065391 |
| 455662 | 1349206_1 | |
| 455713 | 1352512_1 | BE069891 BE158893 BE069898 BE158900 |
| 455759 | 1359316_1 | BE080469 BE080474 BE080477 BE080546 BE080545 |
| 455851 | 1375451_1 | BE146879 BE146914 BE146918 |
| 455853 | 1375671_1 | BE147225 BE147205 BE147234 |
| 455879 | 1380017_1 | BE153275 BE153189 BE153329 BE153022 BE153030 BE152974 |
| 455993 | 1398665_1 | BE179085 BE179084 BE179086 BE179264 |
| 456072 | 1470256_1 | H54381 H54463 BE393262 |
| 456101 | 151654_1 | AA159478 AW901089 AA160437 AW593155 |
| 456212 | 1655565_1 | N51636 T51874 T51829 |
| 456309 | 177026_1 | AA225423 AA225369 BE144153 AW801549 |
| 456714 | 221500_1 | AW897265 AW897274 AL119504 AW897275 AW897270 AW897312 AW897318 AW897317 AA317240 AW961361 T06241 AA326794 AL138130 AW407975 AW999277 |
| 457405 | 333127_1 | AA504860 AA504911 |
| 457620 | 371514_1 | AA602711 BE078290 |
| 457727 | 393566_1 | AW974687 AA649656 AA652145 |
| 457868 | 426095_1 | AW975133 AA729943 AA805813 |
| 458154 | 491768_1 | AW816379 AA888282 AA879046 AA879195 |
| 458804 | 75803_1 | AL157625 N72696 BE622492 |
| 458829 | 773443_1 | AI557388 BE158936 |
| 458841 | 784186_1 | W28965 W28971 |
| 459160 | 920051_1 | AI904723 AI904725 AI904729 AI904722 AI904758 AI904736 |
| 459170 | 920646_1 | AI905518 AI905516 AI905457 AI905515 AW176013 AW176037 |
| 459186 | 922888_1 | AI908287 BE064074 BE068820 BE068823 BE068822 BE068826 |

Pkey Unique Eos probeset identifier number
CAT number Gene cluster number
Accession Genbank accession numbers

TABLE 1C

| Pkey | Ref | Strand | Nt_position |
|---|---|---|---|
| 400584 | 9887612 | Minus | 18398–18573 |
| 400593 | 9887642 | Minus | 25013–25127 |
| 400612 | 9929646 | Minus | 151513–151662 |
| 400613 | 9864507 | Plus | 92278–92472 |
| 400623 | 7228177 | Plus | 74195–74335, 74653–74827 |
| 400709 | 7249204 | Plus | 153075–154680 |
| 400749 | 7331445 | Minus | 9162–9293 |
| 400842 | 1927146 | Plus | 90462–90673 |
| 400925 | 7651921 | Plus | 38183–38391, 43900–44086 |
| 400964 | 7139719 | Minus | 155282–155403 |
| 400968 | 7923967 | Plus | 19938–20043 |
| 400975 | 7139779 | Minus | 108473–108847 |
| 400983 | 8081198 | Plus | 107903–108832 |
| 401032 | 8117525 | Minus | 68451–68555 |
| 401050 | 8117628 | Minus | 78449–79425 |
| 401088 | 8492704 | Plus | 194659–195179 |
| 401129 | 8699792 | Minus | 62022–62242, 62326–62451, 62543–62710, 63072–63167 |
| 401200 | 9743387 | Minus | 111586–111806, 114791–114916, 115419–115583, 116351–116446, 116847–116907, 122853–123067, 124982–125407 |
| 401213 | 9858408 | Plus | 98243–98380, 98489–98619 |
| 401230 | 9929527 | Minus | 33835–34006, 34539–34592, 36461–36745, 48925–49098, 52604–52758 |
| 401245 | 4827300 | Minus | 59373–59531 |
| 401260 | 8076883 | Minus | 86008–86355 |
| 401269 | 8954206 | Plus | 2259–2591 |
| 401283 | 9800093 | Minus | 47256–47456 |
| 401497 | 7381770 | Plus | 92607–92813 |
| 401508 | 7534110 | Minus | 110779–110983 |
| 401521 | 7705251 | Plus | 9127–9234 |
| 401530 | 7770649 | Plus | 41468–42406 |
| 401575 | 7229804 | Minus | 76253–76364 |
| 401604 | 7689963 | Minus | 119835–120185 |
| 401780 | 7249190 | Minus | 28397–28617, 28920–29045, 29135–29296, 29411–29567, 29705–29787, 30224–30573 |
| 401781 | 7249190 | Minus | 83215–83435, 83531–83656, 83740–83901, 84237–84393, 84955–85037, 86290–86814 |
| 401793 | 7263888 | Minus | 102945–103083 |
| 401809 | 7342191 | Minus | 107548–108298 |
| 401862 | 7770606 | Minus | 55839–55993, 59145–59293 |
| 401881 | 8122429 | Minus | 148470–148651, 153418–153618, 154282–154438 |
| 402018 | 7528100 | Plus | 168728–168859 |
| 402046 | 8072415 | Plus | 166394–166556, 168167–168395 |
| 402050 | 8076908 | Minus | 130105–130227 |
| 402071 | 8117361 | Plus | 85924–86039 |
| 402075 | 8117407 | Plus | 121907–122035, 122804–122921, 124019–124161, 124455–124610, 125672–126076 |
| 402131 | 7704961 | Minus | 33114–33209, 33498–33678 |
| 402203 | 8576119 | Minus | 8124–8285 |
| 402222 | 9958106 | Plus | 3261–3834, 3939–4269 |
| 402296 | 6598824 | Plus | 22587–23723 |
| 402298 | 6598824 | Plus | 36758–37953 |
| 402421 | 9796341 | Minus | 46609–46662, 46758–46811, 86293–86346, 89776–89829, 90048–90101, 102817–102924 |
| 402425 | 9796347 | Minus | 50224–50395 |
| 402481 | 9797406 | Plus | 87891–88991 |

TABLE 1C-continued

| Pkey | Ref | Strand | Nt_position |
|---|---|---|---|
| 402529 | 7630937 | Minus | 165–917 |
| 402543 | 9838066 | Minus | 89684–90893 |
| 402576 | 7230225 | Minus | 1867–2247 |
| 402578 | 9884928 | Plus | 66350–66496 |
| 402628 | 9931216 | Plus | 31753–31966 |
| 402631 | 9931231 | Minus | 115658–116580 |
| 402639 | 9958129 | Minus | 20167–22383 |
| 402664 | 8077024 | Plus | 70318–70846 |
| 402709 | 8901246 | Minus | 56847–57055 |
| 402738 | 7331557 | Minus | 8725–8859 |
| 402745 | 9212200 | Minus | 76516–76690 |
| 402790 | 4835258 | Minus | 147744–147861 |
| 402794 | 6136940 | Minus | 131034–131794 |
| 402800 | 6010175 | Plus | 43921–44049, 46181–46273 |
| 402859 | 9588237 | Minus | 69821–75323 |
| 402892 | 8086844 | Minus | 194384–194645 |
| 402974 | 9663349 | Plus | 124035–124321 |
| 403041 | 3171152 | Plus | 70527–71019 |
| 403065 | 8954197 | Minus | 71615–71773, 73930–74144 |
| 403083 | 8954241 | Plus | 163070–163351 |
| 403089 | 8954241 | Plus | 171964–172239 |
| 403093 | 8954241 | Plus | 177083–177373, 177464–177751 |
| 403177 | 9838213 | Minus | 142560–142726 |
| 403273 | 8018055 | Plus | 133809–134099 |
| 403334 | 8568877 | Minus | 137205–137350 |
| 403350 | 8569775 | Minus | 135374–135523 |
| 403356 | 8569930 | Plus | 92839–93036 |
| 403403 | 9438460 | Plus | 21240–21399 |
| 403525 | 7960440 | Plus | 152431–153243 |
| 403568 | 8101145 | Minus | 85509–85658 |
| 403647 | 8699843 | Minus | 35849–36204 |
| 403687 | 7387384 | Plus | 9009–9534 |
| 403691 | 7387384 | Minus | 88280–88463 |
| 403698 | 4263532 | Plus | 10464–10907 |
| 403741 | 7630932 | Minus | 2833–3468 |
| 403747 | 7658395 | Minus | 20493–20621 |
| 403786 | 8083636 | Minus | 73028–73217 |
| 403831 | 7249249 | Minus | 61468–61575 |
| 403891 | 7331467 | Minus | 191508–193220 |
| 403944 | 7711864 | Minus | 129213–129415 |
| 403963 | 8568150 | Plus | 149466–149665 |
| 404070 | 2996642 | Plus | 7210–7414, 10043–10195 |
| 404088 | 9958257 | Plus | 184131–184295 |
| 404097 | 7770701 | Plus | 55512–55781 |
| 404166 | 7596822 | Plus | 86147–86509 |
| 404270 | 9828129 | Minus | 3649–3750, 4161–4306, 5962–6049, 6849–6965 |
| 404340 | 7630856 | Plus | 10898–11506 |
| 404410 | 7342122 | Plus | 49052–49176, 56177–56273, 59384–59488 |
| 404599 | 8705107 | Plus | 110443–110733 |
| 404638 | 9796751 | Minus | 99433–99528, 100035–100161 |
| 404664 | 9797142 | Minus | 104257–105215 |
| 404727 | 8081050 | Plus | 115534–115747 |
| 404767 | 7882827 | Minus | 23244–23759 |
| 404828 | 6580415 | Minus | 26291–27253 |
| 404849 | 7706886 | Plus | 144843–144964, 149846–150121 |
| 404893 | 6850447 | Plus | 65083–65223 |
| 404898 | 7331420 | Minus | 177015–177328 |
| 404952 | 7382669 | Minus | 136326–136618 |
| 404972 | 3213020 | Plus | 48711–49524 |
| 404992 | 4662677 | Minus | 106104–106199, 111659–111781 |
| 405071 | 7708797 | Minus | 11115–11552 |
| 405138 | 8576241 | Plus | 90303–90516 |
| 405196 | 7230083 | Minus | 135716–135851 |
| 405227 | 6731245 | Minus | 22550–22802 |
| 405277 | 3980473 | Plus | 23471–23572 |
| 405285 | 6139075 | Minus | 55744–55903, 57080–57170, 61478–61560 |
| 405292 | 3845420 | Plus | 33227–33442 |
| 405336 | 6094635 | Plus | 33267–33563 |
| 405362 | 2337862 | Minus | 105008–105142, 105980–106091, 140445–140556, 142519–142641 |
| 405382 | 6552767 | Plus | 31923–32311 |
| 405454 | 7656675 | Plus | 133807–134053 |
| 405465 | 7767904 | Plus | 8935–9073, 12242–12367, 13364–13506, 14965–15493 |
| 405472 | 8439781 | Plus | 106297–106447, 108462–108596 |
| 405547 | 1054740 | Plus | 124361–124520, 124914–125050 |
| 405576 | 4003382 | Plus | 84000–85009 |
| 405621 | 5523811 | Plus | 59362–59607 |
| 405636 | 5123990 | Plus | 56384–56587 |
| 405675 | 4557087 | Plus | 70304–70630 |
| 405708 | 4156182 | Plus | 55030–55604 |
| 405771 | 7018349 | Plus | 91191–91254, 91510–91589 |
| 405783 | 5738434 | Minus | 27238–27885 |
| 405793 | 1405887 | Minus | 89197–89453 |
| 405800 | 2791346 | Plus | 19271–19813 |
| 405810 | 4938307 | Minus | 64543–64966 |
| 405848 | 7651809 | Minus | 28135–28244 |
| 405851 | 6164995 | Minus | 26407–27151 |
| 405867 | 6758731 | Minus | 74553–75173 |
| 405896 | 6758795 | Plus | 57311–57874 |
| 405904 | 7705118 | Minus | 16375–16584 |
| 405917 | 7712162 | Minus | 106829–107213 |
| 405982 | 8247790 | Minus | 36028–36408 |
| 406030 | 8312328 | Minus | 96123–96547 |
| 406053 | 6758997 | Plus | 30921–31532 |
| 406057 | 6691254 | Minus | 20830–21222 |
| 406149 | 7144791 | Minus | 44464–45164 |
| 406163 | 7158901 | Plus | 66690–66835 |
| 406277 | 5686030 | Minus | 4759–5490 |
| 406322 | 9212102 | Minus | 130230–130418 |
| 406349 | 9256007 | Minus | 21251–21526 |
| 406504 | 7711360 | Minus | 107068–107277 |
| 406544 | 7711508 | Plus | 46576–40757 |
| 406589 | 8224211 | Plus | 38806–38989 |
| 406592 | 4567182 | Plus | 352560–352963 |

Pkey Unique number corresponding to an Eos probeset
Ref: Sequence source. The 7 digit numbers in this column are Genbank Identifier (GI) numbers. "Dunham I et al." refers to the publication entitled "The DNA sequence of human chromosome 22" Dunham, et al. (1999) Nature 402: 489–495
Strand Indicates DNA strand from which exons were predicted
Nt_position Indicates nucleotide positions of predicted exons TABLE 2A lists about 187 genes up-regulated in ovarian cancer compared to normal adult tissues that are likely to be extracellular or cell-surface proteins. These were selected as for Table 1A, except that the ratio was greater than or equal to 2.5, and the predicted protein contained a PFAM domain that is indicative of extracelluar localization (e.g. ig, fn3, egf, 7tm domains)

TABLE 2A

ABOUT 187 UP-REGULATED OVARIAN CANCER GENES ENCODING EXTRACELLULAR/CELL SURFACE PROTEINS

| Pkey | Ex Accn No | UG ID | Title | PFAM domain | ratio |
|---|---|---|---|---|---|
| 423017 | AW178761 | Hs. 227948 | senne (or cysteine) proteinase inhibito | serpin | 63.6 |
| 431938 | AA938471 | Hs. 115242 | developmentally regulated GTP-bindi | SCP | 32.0 |

TABLE 2A-continued

ABOUT 187 UP-REGULATED OVARIAN CANCER GENES
ENCODING EXTRACELLULAR/CELL SURFACE PROTEINS

| Pkey | Ex Accn No | UG ID | Title | PFAM domain | ratio |
|---|---|---|---|---|---|
| 425650 | NM_001944 | Hs. 1925 | desmoglein 3 (pemphigus vulgaris ant | cadherin | 30.0 |
| 418994 | AA296520 | Hs. 89546 | selectin E (endothelial adhesion molec | EGF, lectin_c, sushi | 24.5 |
| 452947 | AW130413 | | gb: xf50f04.x1 NCI_CGAP_Gas4 Hom | alpha-amylase | 15.8 |
| 418092 | R45154 | Hs. 106604 | ESTs | pkinase, Activin_recp | 15.1 |
| 431725 | X65724 | Hs. 2839 | Nome disease (pseudoglioma) | Cys_knot | 12.6 |
| 422330 | D30783 | Hs. 115263 | epiregulin | EGF | 12.5 |
| 446745 | AW118189 | Hs. 156400 | ESTs | vwa | 11.1 |
| 416319 | AI815601 | Hs. 79197 | CD83 antigen (activated B lymphocyt | ig | 10.8 |
| 432408 | N39127 | Hs. 76391 | myxovirus (influenza) resistance 1, ho | ion_trans, K_tetra | 10.6 |
| 405285 | | | predicted exon | A2M, A2M_N | 10.5 |
| 405636 | | | predicted exon | EGF; ldl_recept_a, ldl_recept_b | 9.8 |
| 403093 | | | predicted exon | fn3 | 9.6 |
| 446740 | AI611635 | Hs. 192605 | ESTs | RYDR_ITPR | 9.2 |
| 405547 | | | predicted exon | ABC_tran, ABC_membrane | 8.5 |
| 412333 | AW937485 | | gb: QV3-DT0044-221299-045-b09 DT | 7tm_f | 8.4 |
| 404270 | | | predicted exon | SCP | 8.1 |
| 402745 | | | predicted exon | EGF, ldl_recept_b, thyroglobulin_1 | 8.1 |
| 452755 | AW134937 | Hs. 213436 | ESTs | cystatin | 8.0 |
| 421459 | AI821539 | Hs. 97249 | ESTs | disintegrin, Reprolysin | 7.9 |
| 416151 | T26661 | | gb: AB65C7R Infant brain, LLNL arra | laminin_G; EGF | 7.8 |
| 446232 | AI281848 | Hs. 165547 | ESts | 7tm_3 | 7.6 |
| 431009 | BE149762 | Hs. 248213 | gap junction protein, beta 6 (connexin | connexin | 7.2 |
| 424634 | NM_003613 | Hs. 151407 | cartilage intermediate layer protein, n | ig, tsp_1 | 7.1 |
| 400749 | | | predicted exon | fn3, ldl_recept_a, ldl_recept_b | 6.8 |
| 419054 | N40340 | Hs. 191510 | ESTs, Weakly similar to ORF2 (M m | ig; SPRY | 6.8 |
| 459170 | AI905518 | | gb: RC-BT091-210199-098 BT091 Ho | ABC_tran; ABC_membrane | 6.6 |
| 416441 | BE407197 | | gb: 601301552F1 NIH_MGC_21 Hom | SDF | 6.4 |
| 410664 | NM_006033 | Hs. 65370 | lipase, endothelial | Ribosomal_L22 | 6.4 |
| 402425 | | | predicted exon | ion_trans | 6.3 |
| 415451 | H19415 | Hs. 268720 | ESTs, Moderately similar to ALU1_H | Ephrin | 6.0 |
| 403083 | | | predicted exon | fn3 | 5.9 |
| 448995 | AI613276 | Hs. 5662 | guanine nucleotide binding protein (G | SDF | 5.9 |
| 418345 | AJ001696 | Hs. 241407 | serine (or cysteine) proteinase inhibito | serpin | 5.8 |
| 424966 | AU077312 | Hs. 153985 | solute carrier family 7 (cationic amino | aa_permeases | 5.8 |
| 431211 | M86849 | Hs. 5566 | gap junction protein, beta 2, 26 kD (co | connexin | 5.7 |
| 430563 | AA481269 | Hs. 178381 | ESTs | ABC_tran, ABC_membrane | 5.6 |
| 450152 | AI138635 | Hs. 22968 | ESTs | ig, pkinase | 5.6 |
| 418844 | M62982 | Hs. 1200 | arachidonate 12-lipoxygenase | lipoxygenase, PLAT | 5.6 |
| 403089 | | | predicted exon | fn3 | 5.6 |
| 403687 | | | predicted exon | tsp_1; Reprolysin | 5.6 |
| 403691 | | | predicted exon | tsp_1; Reprolysin | 5.5 |
| 414035 | Y00630 | Hs. 75716 | serine (or cysteine) proteinase inhibito | serpin | 5.4 |
| 421284 | U62435 | Hs. 103128 | cholinergic receptor, nicotinic, alpha p | neur_chan | 5.3 |
| 435435 | T89473 | Hs. 1932326 | ESTs | liphase, PLAT | 5.3 |
| 457122 | AI026157 | Hs. 33728 | ESTs, Weakly similar to ALU1_HUM | lipoxygenase; PLAT | 5.2 |
| 419249 | X14767 | Hs. 89768 | gamma-aminobutyric acid (GABA) A | neur_chan | 5.2 |
| 425698 | NM_016112 | Hs. 159241 | polycystic kidney disease 2-like 1 | ion_trans | 5.2 |
| 431117 | AF003522 | Hs. 250500 | delta (Drosophila)-like 1 | EGF, DSL | 5.1 |
| 457948 | AI498640 | Hs. 159354 | ESTs | G-alpha; arf | 5.1 |
| 435174 | AA687378 | Hs. 194624 | ESTs | SPRY | 5.0 |
| 408170 | AW204516 | Hs. 31835 | ESTs | arf; ras | 5.0 |
| 434351 | AW974991 | Hs. 191852 | ESTs, Weakly similar to ALU1_HUM | arf; ras | 4.9 |
| 430708 | U78308 | Hs. 278485 | olfactory receptor, family 1, subfamily | 7tm_1 | 4.8 |
| 422597 | BE245909 | Hs. 118634 | ATP-binding cassette, sub-family B (M | ABC_tra; ABC_membane | 4.8 |
| 405545 | | | predicted exon | ABC_tran; ABC_membrane | 4.8 |
| 426471 | M22440 | Hs. 170009 | transforming growth factor, alpha | EGF | 4.7 |
| 409632 | W74001 | Hs. 55279 | serine (or cysteine) proteinase inhibito | serpin | 4.7 |
| 420206 | M91463 | Hs. 95958 | solute carrier family 2 (facilitated gluc | sugar_tr | 4.6 |
| 415138 | C18356 | Hs. 78045 | tissue factor pathway inhibitor 2 | Kunitz_BPTI, G-gamma | 4.6 |
| 424402 | M63108 | Hs. 1769 | luteinizing hormone/chongonadotrop | 7tm_1 | 4.5 |
| 436480 | AJ271643 | Hs. 87469 | putative acid-sensing ion channel | ASC | 4.5 |
| 430226 | BE245562 | Hs. 2551 | adrenergic, beta-2-, receptor, surface | 7tm_1 | 4.4 |
| 436126 | AW449757 | Hs. 163036 | ESTs | SNF | 4.4 |
| 406812 | AF000575 | Hs. 67846 | leukocyte immunoglobulin-like recep | ig | 4.4 |
| 409385 | AA071267 | | gb: zm61g01.r1 Stratagene fibroblast ( | TIMP | 4.3 |
| 449184 | AW296295 | Hs. 196491 | ESTs | TNFR_c6 | 4.3 |
| 410555 | U92649 | Hs. 64311 | a disintegrin and metalloproteinase do | disintegrin, Reprolysin | 4.3 |
| 422389 | AF240635 | Hs. 115897 | profocadherin 12 | cadherin | 4.3 |
| 405281 | | | predicted exon | A2M, A2M_N | 4.3 |
| 413548 | BE147555 | Hs. 288541 | *Homo sapiens* mRNA for KIAA1558 | EGF, ldl_recept_a, ldl_recept_b | 4.3 |
| 449535 | W15267 | Hs. 23672 | low density lipoprotein receptor-relate | ldl_recept_a, EGF, ldl_recept_b | 4.3 |
| 425864 | U56420 | Hs. 159903 | olfactory receptor, family 5, subfamily | 7tm_1 | 4.3 |
| 410611 | AW954134 | Hs. 20924 | KIAA1628 protein | Peptidase_S9 | 4.2 |
| 430686 | NM_001942 | Hs. 2633 | desmoglein 1 | cadherin, Cadherin_C_term | 4.1 |

TABLE 2A-continued

ABOUT 187 UP-REGULATED OVARIAN CANCER GENES
ENCODING EXTRACELLULAR/CELL SURFACE PROTEINS

| Pkey | Ex Accn No | UG ID | Title | PFAM domain | ratio |
|---|---|---|---|---|---|
| 418693 | AI750878 | Hs. 87409 | thrombospondin 1 | vwc, TSPN | 4.0 |
| 445924 | AI264671 | Hs. 164166 | ESTs | sugar_tr | 3.9 |
| 457148 | AF091035 | Hs. 184627 | KIAA0118 protein | arf; ras | 3.9 |
| 428568 | AC004755 | Hs. 184922 | one cut domain, family member 3 | E1-E2_ATPase | 3.9 |
| 412170 | D16532 | Hs. 73729 | very low density lipoprotein receptor | EGF, ldl_recept_a; ldl_recept_b | 3.8 |
| 442566 | R37337 | Hs. 12111 | ESTs | ank, death, RHD, TIG | 3.8 |
| 403763 | | | predicted exon | 7tm_1 | 3.8 |
| 403074 | | | predicted exon | fn3 | 3.8 |
| 413605 | BE152644 | | gb: CM1-HT0329-250200-128-f09 HT | alpha-amylase | 3.8 |
| 442295 | AI827248 | Hs. 224398 | Homo sapiens cDNA FLJ11469 fis, c | Collagen, COLFI | 3.7 |
| 403661 | | | predicted exon | 7tm_3, ANF_receptor | 3.7 |
| 407305 | AA715284 | | gb: nv35f03.r1 NCI_CGAP_Br5 Hom | pkinase, Sema; Pfexin_repeat, TIG | 3.7 |
| 457353 | X65633 | Hs. 248144 | melanocortin 2 receptor (adrenocortic | 7tm_1 | 3.7 |
| 431176 | AI026984 | Hs. 293662 | ESTs | laminin_EGF; laminin_B | 3.6 |
| 436233 | AI742878 | Hs. 124116 | ESTs | ig | 3.6 |
| 431808 | M30703 | Hs. 270833 | amphiregulin (schwannoma-derived g | EGF | 3.6 |
| 445798 | NM_012421 | Hs. 13321 | rearranged L-myc fusion sequence | zf-C2H2 | 3.6 |
| 400380 | NM_018485 | Hs. 283079 | G protein-coupled receptor C5L2 | 7tm_1 | 3.6 |
| 453893 | NM_000835 | Hs. 36451 | glutamate receptor, ionotropic, N-met | lig_chan | 3.5 |
| 409402 | AF208234 | Hs. 695 | cystatin B (stefin B) | cystatin | 3.5 |
| 421166 | AA305407 | Hs. 102308 | potassium inwardly-rectifying channe | IRK | 3.5 |
| 445575 | Z25368 | Hs. 172004 | titin | fn3 | 3.5 |
| 428957 | NM_003881 | Hs. 194679 | WNT1 inducible signaling pathway p | tsp_1, vwc, IGFBP | 3.5 |
| 403909 | NM_016255 | Hs. 95260 | Homo sapiens mRNA; cDNA DKFZp | Na_H_Exchanger | 3.5 |
| 403077 | | | predicted exon | fn3 | 3.5 |
| 455612 | BE042896 | Hs. 274848 | ESTs | ABC_tran, ABC_membrane | 3.5 |
| 424091 | AF235097 | Hs. 139263 | calcium channel, voltage-dependent, a | ion_trans | 3.5 |
| 403956 | W28077 | Hs. 79389 | nel (chicken)-like 2 | cadherin, Cadherin_C_term | 3.4 |
| 457470 | AB040973 | Hs. 272385 | protein-coupled receptor 72 | 7tm_1 | 3.4 |
| 401522 | N47812 | Hs. 81360 | CGI-35 protein | disintegrin; Reprolysin | 3.4 |
| 404886 | | | predicted exon | ion_trans | 3.4 |
| 437692 | AA176959 | Hs. 172004 | titin | fn3 | 3.4 |
| 407944 | R34008 | Hs. 239727 | desmocollin 2 | cadherin | 3.4 |
| 407393 | AB038237 | | gb: Homo sapiens mRNA for G protei | 7tm_1 | 3.3 |
| 436936 | AL134451 | Hs. 197478 | ESTs | EGF, laminin_G | 3.3 |
| 423309 | BE006775 | Hs. 126782 | sushi-repeat protein | sushi, HYR | 3.3 |
| 402172 | | | predicted exon | ig | 3.3 |
| 447420 | AI378628 | | gb: tc72g07.x1 Soares_NhHMPu_S1 H | ank; pkinase, death | 3.3 |
| 438901 | AF085834 | Hs. 29036 | ESTs | sushi | 3.3 |
| 424362 | AL137646 | Hs. 146001 | Homo sapiens mRNA, cDNA DKFZp | trypsin, sushi, CUB | 3.3 |
| 430453 | BE387060 | Hs. 3903 | Cdc42 effector protein 4, binder of Rh | fn3 | 3.3 |
| 416631 | H69466 | | gb: yr88f07 r1 Soares fetal liver spleen | ldl_recept_a; MACPF | 3.3 |
| 453174 | AI633529 | Hs. 135238 | ESTa | 7tm_1 | 3.3 |
| 433848 | AF095719 | Hs. 93764 | carboxypeptidase A3 | Zn_carbOpept, Propep_M14 | 3.2 |
| 408546 | W49512 | Hs. 46348 | bradykinin receptor B1 | 7tm_1 | 3.2 |
| 423573 | AA328504 | | gb: EST31993 Embryo, 12 week I Hom | 7tm_1 | 3.2 |
| 458662 | AI823410 | Hs. 169149 | karyopherin alpha 1 (importin alpha 5 | 7tm_3, ANF_receptor | 3.2 |
| 433430 | AI863735 | Hs. 186755 | ESTs | thyroglobulin_1, IGFBP | 3.2 |
| 438850 | R33727 | Hs. 24688 | EST | ank; pkinase, death | 3.2 |
| 420783 | AI659838 | Hs. 99923 | lectin, galactoside-binding, soluble, 7 | Gal-bind_lectin | 3.2 |
| 409968 | U56102 | Hs. 57699 | adhesion glycoprotein | ig | 3.1 |
| 430630 | AW269920 | Hs. 2621 | cystatin A (stefin A) | 7tm_3, ANF_receptor | 3.1 |
| 420737 | L08096 | Hs. 99899 | tumor necrosis factor (ligand) superfa | TNF | 3.1 |
| 422279 | H69644 | Hs. 114231 | C-type lectin-like receptor-2 | lectin_c | 3.1 |
| 400289 | X07820 | Hs. 2258 | matrix metalloproteinase 10 (stromely | hemopexin, Peptidase_M10 | 3.1 |
| 412597 | AU077051 | Hs. 74561 | alpha-2-macroglobulin | A2M, A2M_N | 3.1 |
| 453420 | AJ003459 | | gb: AJ003459 Setected chromosome 2 | IRK | 3.1 |
| 404243 | | | predicted exon | zf-C3HC4, SPRY; zf-B_box | 3.1 |
| 449987 | AW079749 | Hs. 184719 | ESTs, Weakly similar to AF116721 1 | ABC_tran; ABC_membrane | 3.1 |
| 422471 | AA311027 | Hs. 271894 | ESTs | ig | 3.0 |
| 400464 | | | predicted exon | Peptidase_S9 | 3.0 |
| 458713 | BE044496 | Hs. 282707 | ESTs | EGF | 3.0 |
| 421340 | F07783 | Hs. 1369 | decay accelerating factor for complem | sushi | 3.0 |
| 449523 | NM_000579 | Hs. 54443 | chemokine (C-C motif) receptor 5 | 7tm_1 | 3.0 |
| 400704 | | | predicted exon | lig_chan, ANF_receptor | 3.0 |
| 416239 | AL038450 | Hs. 48948 | ESTs | E1-E2_ATPase; Hydrolase | 3.0 |
| 433664 | AW292176 | Hs. 245834 | ESTs | Ricin_B_lectin | 3.0 |
| 423994 | X01057 | Hs. 1724 | interleukin 2 receptor, alpha | rrm | 2.9 |
| 447726 | AL137638 | Hs. 19368 | Homo sapiens mRNA, cDNA DKFZp | vwa | 2.9 |
| 425483 | AF231022 | Hs. 301273 | Homo sapiens protocadherin Fat 2 (FA | EGF; cadherin, laminin_G | 2.9 |
| 423513 | AF035960 | Hs. 129719 | transglutaminase 5 | Transglut_core; Transglutamin_N | 2.9 |
| 401537 | | | predicted exon | ig, pkinase, LRRNT; LRRCT | 2.9 |
| 405790 | | | predicted exon | Sema; Plexin_repeat; TIG | 2.9 |
| 422669 | H12402 | Hs. 119122 | ribosomal protein L13a | arf; ras; Ribosomal_S17 | 2.9 |

TABLE 2A-continued

ABOUT 187 UP-REGULATED OVARIAN CANCER GENES ENCODING EXTRACELLULAR/CELL SURFACE PROTEINS

| Pkey | Ex Accn No | UG ID | Title | PFAM domain | ratio |
|---|---|---|---|---|---|
| 430793 | M83181 | Hs. 247940 | 5-hydroxytryptamine (serotonin) recep | 7tm_1 | 2.9 |
| 403411 | | | predicted exon | ABC_tran, ABC_membrane | 2.8 |
| 428188 | M98447 | Hs. 22 | transglutaminase 1 (K polypeptide ep | Transglutamin_N; Transglut_core | 2.8 |
| 414482 | S57498 | Hs. 76252 | endothelin receptor type A | 7tm_1 | 2.8 |
| 427223 | BE208189 | Hs. 174031 | cytochrome c oxidase subunit VIb | COX6B | 2.8 |
| 404187 | | | predicted exon | ig | 2.8 |
| 443537 | D13305 | Hs. 203 | cholecystokinin B receptor | 7tm_1 | 2.8 |
| 428701 | NM_013276 | Hs. 190207 | carbohydrate kinase-like | vwa; integrin_A, P2X_receptor | 2.7 |
| 411213 | AA676939 | Hs. 69285 | neuropilin 1 | CUB; MAM, F5_F8_type_C | 2.7 |
| 453999 | BE328153 | Hs. 240087 | ESTs | kazal | 2.7 |
| 401244 | | | predicted exon | vwa, vwd, TIL | 2.7 |
| 458930 | NM_003612 | Hs. 24640 | sema domain, immunoglobulin domai | Sema | 2.7 |
| 434411 | AA632649 | Hs. 201372 | ESTs | sushi | 2.7 |
| 400421 | AF263537 | Hs. 287370 | fibroblast growth factor 23 | FGF | 2.7 |
| 448999 | AF179274 | Hs. 22791 | transmembrane protein with EGF-like | kazal | 2.7 |
| 417350 | U50928 | Hs. 82001 | polycystic kidney disease 2 (autosoma | ion_trans | 2.6 |
| 419452 | U33635 | Hs. 90572 | PTK7 protein tyrosine kinase 7 | pkinase, ig | 2.6 |
| 401657 | | | predicted exon | 7tm_1 | 2.6 |
| 456711 | AA033699 | Hs. 83938 | ESTs, Moderately similar to MASP-2 | sushi, trypsin, CUB | 2.6 |
| 432042 | AW971345 | Hs. 292715 | ESTs | sugar_tr | 2.6 |
| 433138 | AB029496 | Hs. 59729 | semaphonn sem2 | ig, Sema | 2.6 |
| 452530 | AI905518 | | gb: RC-BT091-210199-098 BT091 Ho | ABC_tran, ABC_membrane | 2.6 |
| 426418 | M90464 | Hs. 169825 | collagen, type IV, alpha 5 (Alport syn | Collagen, C4 | 2.6 |
| 403796 | | | predicted exon | cadherin | 2.6 |
| 431728 | NM_007351 | Hs. 268107 | multimerin | EGF; C1q | 2.6 |
| 441595 | AW206035 | Hs. 192123 | ESTs | sugar_tr | 2.6 |
| 445537 | AJ245671 | Hs. 12844 | EGF-like-domain, multiple 6 | EGF, MAM | 2.6 |
| 447197 | R36075 | | gb: yh88b01.s1 Soares placenta Nb2H | SDF | 2.5 |
| 428765 | X54150 | Hs. 193122 | Fc fragment of IgA, receptor for | ig | 2.5 |
| 450245 | AA007536 | Hs. 271767 | ESTs, Moderately similar to ALU1_H | ig | 2.5 |
| 416429 | H54658 | Hs. 268942 | ESTs | E1-E2_ATPase, Hydrolase | 2.5 |
| 417067 | AJ001417 | Hs. 81086 | solute carrier family 22 (extraneurona | sugar_tr | 2.5 |
| 433182 | AB039920 | Hs. 127821 | BWRT protein | ion_trans | 2.5 |
| 403092 | | | predicted exon | fn3 | 2.5 |
| 406850 | AI624300 | Hs. 172928 | collagen, type I, alpha 1 | vwc, Collagen, COLFI | 2.5 |
| 438698 | AW297855 | Hs. 125815 | ESTs | lipoxygenase, PLAT | 2.5 |
| 456815 | NM_013348 | Hs. 144011 | potassium inwardly-rectifying channe | IRK | 2.5 |

Pkey: Primekey
Ex. Accn Exemplar Accession
UG ID. UniGene ID
Title. Unigene Title
PFAM domains
ratio: tumor vs normal tissues

TABLE 2B

| Pkey | CAT Number | Accession |
|---|---|---|
| 409385 | 112523_1 | AA071267 T65940 T64515 AA071334 |
| 412333 | 1289037_1 | AW937485 AW937589 AW937658 AW937654 AW937492 |
| 413605 | 1379792_1 | BE152644 BE152712 BE152668 BE152659 BE152810 BE152811 BE152816 BE152643 BE152706 BE152656 BE152660 BE152715 BE152662 BE152669 BE152661 BE152672 BE152653 BE152716 BE152651 BE152767 BE152677 BE152652 BE152714 BE152708 BE152665 BE152679 BE152771 BE152775 BE152666 BE152768 BE152813 BE152664 BE152676 BE152681 BE152709 BE152667 BE152814 BE152808 BE152711 BE152707 BE152815 BE152678 BE152673 BE152782 BE152671 BE152682 BE152760 BE152809 BE152778 BE152780 BE152762 BE152776 BE152781 BE152774 BE152763 BE152769 |
| 416151 | 1573926_1 | T26661 Z44135 H23016 |
| 416441 | 159480_1 | BE407197 AA182474 AA180369 BE275628 BE276131 |
| 416631 | 1605019_1 | H69466 H93884 N59684 |
| 423573 | 229714_1 | AA328504 AA327783 AW962370 |
| 447197 | 711623_1 | R36075 AI366546 R36167 |
| 447420 | 721207_1 | AI378628 N32350 H85772 |
| 452530 | 920646_1 | AI905518 AI905516 AI905457 AI905515 AW176013 AW176037 |
| 452947 | 939810_1 | AW130413 AI932362 |
| 453420 | 966433_1 | AJ003459 AJ003461 |
| 459170 | 920646_1 | AI905518 AI905516 AI905457 AI905515 AW176013 AW176037 |

Pkey: Unique Eos probeset identifier number
CAT number: Gene cluster number
Accession: Genbank accession numbers

TABLE 2C

| Pkey | Ref | Strand | Nt_position |
|---|---|---|---|
| 400464 | 9929670 | Plus | 22074–22214 |
| 400704 | 8118864 | Minus | 63110–63241 |

TABLE 2C-continued

| Pkey | Ref | Strand | Nt_position |
|---|---|---|---|
| 400749 | 7331445 | Minus | 9162–9293 |
| 401244 | 4827300 | Minus | 55359–56376 |
| 401537 | 7960358 | Minus | 186786–187029, 190607–190779, 198218–198348 |
| 401657 | 9100664 | Minus | 7312–8163 |
| 402172 | 8575911 | Minus | 143378–143671 |
| 402425 | 9796347 | Minus | 50224–50395 |
| 402745 | 9212200 | Minus | 76516–76690 |
| 403074 | 8954241 | Plus | 143375–143561 |
| 403077 | 8954241 | Plus | 146923–147222, 147326–147628 |
| 403083 | 8954241 | Plus | 163070–163351 |
| 403089 | 8954241 | Plus | 171964–172239 |
| 403092 | 8954241 | Plus | 174720–175016, 175104–175406, 175508–175813 |
| 403093 | 8954241 | Plus | 177083–177373, 177464–177751 |
| 403411 | 9438635 | Minus | 104247–104420 |
| 403661 | 8705027 | Minus | 30268–30482 |
| 403687 | 7387384 | Plus | 9009–9534 |
| 403691 | 7387384 | Minus | 88280–88463 |
| 403763 | 7229888 | Minus | 43575–43887 |
| 403796 | 8099896 | Minus | 75073–77664 |
| 404187 | 4481839 | Plus | 7644–7991 |
| 404243 | 5672609 | Plus | 74695–75123 |
| 404270 | 9828129 | Minus | 3649–3750, 4161–4306, 5962–6049, 6849–6965 |
| 404886 | 4884062 | Plus | 30058–30596 |
| 405281 | 6139075 | Minus | 34202–34351, 35194–35336, 45412–45475, 45731–45958, 47296–47457, 49549–49658, 49790–49904, 50231–50342, 53583–53667, 54111–54279 |
| 405285 | 6139075 | Minus | 55744–55903, 57080–57170, 61478–61560 |
| 405545 | 1054740 | Plus | 118677–118807, 119091–119296, 121626–121823 |
| 405547 | 1054740 | Plus | 124361–124520, 124914–125050 |
| 405636 | 5123990 | Plus | 56384–56587 |
| 405790 | 1203968 | Plus | 136364–136509, 136579–136699, 136805–136941 |

Pkey: Unique number corresponding to an Eos probeset
Ref Sequence source The 7 digit numbers in this column are Genbank Identifier (Gt) numbers "Dunham I. et al" refers to the publication entitled "The DNA sequence of human chromosome 22" Dunham, et al (1999) Nature 402: 489–495
Strand Indicates DNA strand from which exons were predicted
Nt_position Indicates nucleotide positions of predicted exons TABLE 3A lists about 1643 genes up-regulated in ovarian cancer compared to normal ovaries. These were selected as for Table 1A, except that the ration was greater than or equal to 15, and the denominator was the arithmetic mean value for various non-malignant ovary specimens obtained

TABLE 3A

ABOUT 1643 UP-REGULATED GENES, OVARIAN CANCER VERSUS NORMAL OVARY

| Pkey | Ex Accn No. | UG ID | Title | ratio |
|---|---|---|---|---|
| 420859 | AW468397 | Hs. 100000 | S100 calcium-binding protein A8 (calgranulin A) | 219.9 |
| 422166 | W72424 | Hs. 112405 | S100 calcium-binding protein A9 (calgranulin B) | 180.2 |
| 422158 | L10343 | Hs. 112341 | protease inhibitor 3, skin-derived (SKALP) | 165.0 |
| 424799 | BE550723 | Hs. 153179 | fatty acid binding protein 5 (psoriasis-associated) | 161.5 |
| 442402 | NM_000954 | Hs. 8272 | prostaglandin D2 synthase (21 kD, brain) | 150.2 |
| 408522 | AI541214 | Hs. 46320 | Small proline-rich protein SPRK [human, odontogenic k | 149.5 |
| 431369 | BE184455 | Hs. 251754 | secretory leukocyte protease inhibitor (antileukoprotein | 144.9 |
| 430520 | NM_016190 | Hs. 242057 | chromosome 1 open reading frame 10 | 136.6 |
| 428471 | X57348 | Hs. 184510 | stratifin | 129.5 |
| 421978 | AJ243662 | Hs. 110196 | NICE-1 protein | 108.7 |
| 437191 | NM_006846 | Hs. 5476 | serine protease inhibitor, Kazal type, 5 | 106.2 |
| 407788 | BE514982 | Hs. 38991 | S100 calcium-binding protein A2 | 105.5 |
| 441565 | AW953575 | Hs. 169902 | solute carrier family 2 (facilitated glucose transporter), | 103.6 |
| 431211 | M86849 | Hs. 5566 | gap junction protein, beta 2, 26 kD (connexin 26) | 102.1 |
| 419329 | AY007220 | Hs. 288998 | S100-type calcium binding protein A14 | 95.3 |
| 430572 | U33114 | Hs. 245188 | tissue inhibitor of metalloproteinase 3 (Sorsby fundus d | 87.0 |
| 417079 | U65590 | Hs. 81134 | interleukin 1 receptor antagonist | 86.1 |
| 412636 | NM_004415 | Hs. 74316 | desmoplakin (DPI, DPII) | 85.0 |
| 417515 | L24203 | Hs. 82237 | ataxia-telangiectasia group D-associated protein | 84.8 |
| 426295 | AW367283 | Hs. 75839 | zinc finger protein 6 (CMPX1) | 84.5 |
| 452669 | AA216363 | Hs. 262958 | ESTs, Weakly similar to alternatively spliced product u | 84.4 |
| 406711 | N25514 | Hs. 77385 | myosin, light polypeptide 6, alkali, smooth muscle and n | 83.8 |
| 406712 | M31212 | Hs. 77385 | myosin, light polypeptide 6, alkali, smooth muscle and n | 81.0 |
| 432680 | T47364 | Hs. 278613 | interferon, alpha-inducible protein 27 | 81.0 |
| 416889 | AW250318 | Hs. 80395 | mal, T-cell differentiation protein | 77.8 |
| 409453 | AI885516 | Hs. 95612 | ESTs | 75.3 |
| 424670 | W61215 | Hs. 116651 | epithelial V-like antigen 1 | 67.5 |
| 417130 | AW276858 | Hs. 81256 | S100 calcium-binding protein A4 (calcium protein, calv | 67.0 |
| 423634 | AW959908 | Hs. 1690 | heparin-binding growth factor binding protein | 65.7 |
| 442379 | NM_004613 | Hs. 8265 | transglutaminase 2 (C polypeptide, protein-glutamine-g | 64.7 |
| 456898 | NM_001928 | Hs. 155597 | D component of complement (adipsin) | 64.6 |
| 423017 | AW178761 | Hs. 227948 | serine (or cysteine) proteinase inhibitor, clade B (ovalbu | 63.6 |
| 447990 | BE048821 | Hs. 20144 | small inducible cytokine subfamily A (Cys-Cys), memb | 60.7 |
| 424362 | AL137646 | Hs. 146001 | Homo sapiens mRNA, cDNA DKFZp586F0824 (from | 60.3 |
| 414438 | AI879277 | Hs. 76136 | thioredoxin | 59.9 |
| 420136 | AW801090 | Hs. 195851 | actin, alpha 2, smooth muscle, aorta | 58.9 |
| 433336 | AF017986 | Hs. 31386 | ESTs, Highly similar to JE0174 frizzled protein-2 [H. sa | 58.8 |
| 403741 | | | predicted exon | 57.0 |
| 430637 | BE160081 | Hs. 256290 | S100 calcium-binding protein A11 (calgizzarin) | 56.1 |
| 424098 | AF077374 | Hs. 139322 | small proline-rich protein 3 | 55.8 |
| 441591 | AF055992 | Hs. 183 | Duffy blood group | 55.6 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 426521 | AF161445 | Hs. 170219 | hypothetical protein | 55.5 |
| 406713 | U02629 | Hs. 77385 | myosin, light polypeptide 6, alkali, smooth muscle and n | 55.3 |
| 406725 | D51245 | Hs. 288061 | actin, beta | 54.1 |
| 422168 | AA586894 | Hs. 112408 | S100 calcium-binding protein A7 (psoriasin 1) | 54.1 |
| 406755 | N80129 | Hs. 94360 | metallothionein 1L | 54.0 |
| 425593 | AA278921 | Hs. 1908 | proteoglycan 1, secretory granule | 53.3 |
| 442257 | AW503831 | | gb: UI-HF-BN0-alb-b-05-0-UI.r1 NIH_MGC_50 Homo | 53.1 |
| 421957 | AW068637 | Hs. 109857 | hypothetical protein DKFZp434H0820 | 52.3 |
| 447526 | AL048753 | Hs. 340 | small inducible cytokine A2 (monocyte chemotactic pro | 51.2 |
| 406722 | H27498 | Hs. 283305 | *Homo sapiens* SNC73 protein (SNC73) mRNA, comple | 51.0 |
| 427223 | BE208189 | Hs. 174031 | cytochrome c oxidase subunit VIb | 51.0 |
| 414420 | AA043424 | Hs. 76095 | immediate early response 3 | 50.9 |
| 417259 | AW903838 | Hs. 81800 | chondroitin sulfate proteoglycan 2 (versican) | 50.3 |
| 414191 | AW250089 | Hs. 75807 | PDZ and LIM domain 1 (elfin) | 49.5 |
| 436906 | H95990 | Hs. 181244 | major histocompatibility complex, class I, A | 49.0 |
| 408000 | L11690 | Hs. 620 | bullous pemphigoid antigen 1 (230/240 kD) | 49.0 |
| 414035 | Y00630 | Hs. 75716 | serine (or cysteine) proteinase inhibitor, clade B (ovalbu | 48.8 |
| 432706 | NM_013230 | Hs. 286124 | CD24 antigen (small cell lung carcinoma cluster 4 antig | 48.8 |
| 421948 | L42583 | Hs. 111758 | keratin 6A | 48.7 |
| 414662 | AL036058 | Hs. 76807 | major histocompatibility complex, class II, DR alpha | 48.5 |
| 425071 | NM_013989 | Hs. 154424 | deiodinase, iodothyronine, type II | 48.5 |
| 404767 | | | predicted exon | 48.4 |
| 418327 | U70370 | Hs. 84136 | paired-like homeodomain transcription factor 1 | 48.2 |
| 436729 | BE621807 | Hs. 3337 | transmembrane 4 superfamily member 1 | 47.7 |
| 414183 | AW957446 | Hs. 301711 | ESTs | 47.2 |
| 400163 | | | predicted exon | 47.0 |
| 433423 | BE407127 | Hs. 8997 | heat shock 70 kD protein 1A | 46.9 |
| 423457 | F08208 | Hs. 155606 | paired mesoderm homeo box 1 | 46.6 |
| 414085 | AA114016 | Hs. 75746 | aldehyde dehydrogenase 6 | 46.0 |
| 423189 | M59371 | Hs. 171596 | EphA2 | 45.6 |
| 438240 | N92638 | Hs. 124004 | ESTs | 45.5 |
| 417366 | BE185289 | Hs. 1076 | small proline-rich protein 1B (cornifin) | 45.3 |
| 412774 | AA120865 | Hs. 23136 | ESTs | 45.1 |
| 407242 | M18728 | | gb: Human nonspecific crossreacting antigen mRNA, co | 44.8 |
| 431292 | AA370141 | Hs. 251453 | Human DNA sequence from clone 967N21 on chromos | 44.8 |
| 403695 | | | predicted exon | 43.5 |
| 417365 | D50683 | Hs. 82028 | transforming growth factor, beta receptor II (70–80 kD) | 43.4 |
| 432331 | W37862 | Hs. 274368 | *Homo sapiens* mRNA, cDNA DKFZp586I1524 (from c | 43.4 |
| 424479 | AF064238 | Hs. 149098 | smoothelin | 43.3 |
| 444726 | NM_006147 | Hs. 11801 | interferon regulatory factor 6 | 43.2 |
| 432314 | AA533447 | Hs. 285173 | ESTs | 43.2 |
| 429500 | X78565 | Hs. 289114 | hexabrachion (tenascin C, cytotactin) | 43.1 |
| 441406 | Z45957 | Hs. 7837 | *Homo sapiens* cDNA FLJ10457 fis, clone NT2RP1001 | 42.7 |
| 412969 | AI373162 | Hs. 75103 | tyrosine 3-monooxygenase/tryptophan 5-monooxygenas | 42.6 |
| 423720 | AL044191 | Hs. 23388 | *Homo sapiens* cDNA FLJ21310 fis, clone COL02160 | 42.5 |
| 400111 | | | predicted exon | 42.4 |
| 407207 | T03651 | Hs. 179661 | tubulin, beta polypeptide | 42.4 |
| 417164 | AA338283 | Hs. 81361 | heterogeneous nuclear ribonucleoprotein A/B | 42.2 |
| 424971 | AA479005 | Hs. 154036 | tumor suppressing subtransferable candidate 3 | 41.9 |
| 439394 | AA149250 | Hs. 56105 | ESTs, Weakly similar to WDNM RAT WDNM1 PROT | 41.9 |
| 406657 | AI678644 | Hs. 277477 | major histocompatibility complex, class I, C | 41.8 |
| 451092 | AI207256 | Hs. 13766 | *Homo sapiens* mRNA for FLJ00074 protein, partial cds | 41.6 |
| 412596 | AA161219 | Hs. 799 | diphtheria toxin receptor (heparin-binding epidermal gro | 41.6 |
| 422103 | AA984330 | Hs. 111676 | protein kinase H11, small stress protein-like protein HS | 41.5 |
| 428785 | AI015953 | Hs. 125265 | ESTs | 41.3 |
| 450988 | BE618571 | Hs. 429 | ATP synthase, H+ transporting, mitochondrial F0 comp | 41.0 |
| 414622 | AI752666 | Hs. 76669 | nicotinamide N-methyltransferase | 40.8 |
| 405022 | | | predicted exon | 40.8 |
| 408221 | AA912183 | Hs. 47447 | ESTs | 40.8 |
| 446500 | U78093 | Hs. 15154 | sushi-repeat-containing protein, X chromosome | 40.7 |
| 421416 | BE302950 | Hs. 104125 | adenylyl cyclase-associated protein | 40.6 |
| 412247 | AF022375 | Hs. 73793 | vascular endothelial growth factor | 40.5 |
| 410541 | AA065003 | Hs. 64179 | hypothetical protein | 40.5 |
| 406658 | AI920965 | Hs. 77961 | major histocompatibility complex, class I, B | 40.0 |
| 420225 | AW243046 | Hs. 94789 | ESTs | 40.0 |
| 406825 | AI982529 | Hs. 84298 | CD74 antigen (invariant polypeptide of major histocom | 39.4 |
| 443623 | AA345519 | Hs. 9641 | complement component 1, q subcomponent, alpha poly | 39.4 |
| 404201 | AF059566 | Hs. 103983 | solute carrier family 5 (sodium iodide symporter), mem | 39.3 |
| 405138 | | | predicted exon | 39.1 |
| 408733 | AW264812 | Hs. 254290 | ESTs | 39.0 |
| 414044 | BE614194 | Hs. 75721 | profilin 1 | 38.9 |
| 430152 | AB001325 | Hs. 234642 | aquaporin 3 | 38.8 |
| 428121 | AB006622 | Hs. 182536 | *Homo sapiens* cDNA FLJ21370 fis, clone COL03092 | 38.8 |
| 434311 | BE543469 | Hs. 266263 | *Homo sapiens* cDNA FLJ14115 fis, clone MAMMA10 | 38.7 |
| 406140 | | | predicted exon | 38.5 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 432918 | AF077200 | Hs. 279813 | hypothetical protein | 38.4 |
| 420107 | AL043980 | Hs. 7886 | pellino (Drosophila) homolog 1 | 38.4 |
| 427693 | BE546832 | Hs. 180370 | cofilin 1 (non-muscle) | 38.1 |
| 448835 | BE277929 | Hs. 11081 | ESTs, Weakly similar to S57447 HPBRII-7 protein [H. | 38.1 |
| 432374 | W68815 | Hs. 301885 | Homo sapiens cDNA FLJ11346 fis, clone PLACE1010 | 37.9 |
| 428383 | BE616599 | Hs. 184029 | hypothetical protein DKFZp761A052 | 37.7 |
| 436258 | AW867491 | Hs. 107125 | ESTs, Weakly similar to S57447 HPBRII-7 protein [H. | 37.7 |
| 420798 | W93774 | Hs. 99936 | keratin 10 (epidermolytic hyperkeratosis; keratosis palm | 37.7 |
| 400327 | M18679 | Hs. 247942 | Human variant 5S rRNA-like gene and ORF, complete | 37.6 |
| 401781 | | | predicted exon | 37.6 |
| 448257 | AW772070 | Hs. 253146 | ESTs | 37.3 |
| 428415 | AA337211 | Hs. 184222 | Down syndrome critical region gene 1 | 37.2 |
| 424206 | NM_003734 | Hs. 198241 | amine oxidase, copper containing 3 (vascular adhesion p | 37.2 |
| 406812 | AF000575 | Hs. 67846 | leukocyte immunoglobulin-like receptor, subfamily B ( | 37.2 |
| 425882 | U83115 | Hs. 161002 | absent in melanoma 1 | 37.2 |
| 432501 | BE546532 | Hs. 287329 | Fas binding protein 1 | 37.1 |
| 421786 | AI188653 | Hs. 21351 | ESTs | 37.1 |
| 427981 | BE275986 | Hs. 181311 | asparaginyl-tRNA synthetase | 37.0 |
| 410143 | AA188169 | Hs. 288819 | Homo sapiens cDNA FLJ21022 fis, clone CAE06383 | 36.8 |
| 451328 | AW853606 | Hs. 109012 | ESTs | 36.7 |
| 414135 | NM_004419 | Hs. 2128 | dual specificity phosphatase 5 | 36.7 |
| 414602 | AW630088 | Hs. 76550 | Homo sapiens mRNA; cDNA DKFZp564B1264 (from | 36.7 |
| 401785 | | | predicted exon | 36.5 |
| 411469 | T09997 | Hs. 70327 | cysteine-rich protein 2 | 36.2 |
| 419693 | AA133749 | Hs. 92323 | FXYD domain-containing ion transport regulator 3 | 36.1 |
| 417039 | AA302180 | Hs. 80986 | ATP synthase, H+ transporting, mitochondrial F0 comp | 36.1 |
| 406718 | AA505525 | Hs. 169476 | glyceraldehyde-3-phosphate dehydrogenase | 36.0 |
| 402543 | | | predicted exon | 36.0 |
| 408669 | AI493591 | Hs. 78146 | platelet/endothelial cell adhesion molecule (CD31 antig | 35.9 |
| 414987 | AA524394 | Hs. 165544 | ESTs | 35.9 |
| 445810 | AW265700 | Hs. 155660 | ESTs | 35.9 |
| 406653 | AA574074 | Hs. 77961 | major histocompatibility complex, class I, B | 35.7 |
| 407498 | U28131 | | gb: Human HMGI-C chimeric transcript mRNA, partial | 35.6 |
| 412524 | AA417813 | Hs. 11177 | ESTs | 35.5 |
| 401521 | | | predicted exon | 35.4 |
| 408948 | AW296713 | Hs. 221441 | ESTs | 35.1 |
| 406728 | AI986345 | Hs. 183704 | ubiquitin C | 34.9 |
| 440669 | AI206964 | | gb: qr30g06.x1 NCI_CGAP_GC6 Homo sapiens cDNA | 34.8 |
| 422658 | AF231981 | Hs. 250175 | homolog of yeast long chain polyunsaturated fatty acid | 34.8 |
| 452924 | AW580939 | Hs. 97199 | complement component C1q receptor | 34.7 |
| 428600 | AW863261 | Hs. 15036 | ESTs, Highly similar to AF161358 1 HSPC095 [H. sapi | 34.7 |
| 409828 | AW501137 | | gb: UI-HF-BP0p-ait-e-12-0-UI.r1 NIH_MGC_51 Homo | 34.5 |
| 459390 | BE385725 | | gb: 601276347F1 NIH_MGC_20 Homo sapiens cDNA | 34.5 |
| 445055 | BE512856 | Hs. 109051 | glycoprotein, synaptic 2 | 34.3 |
| 411789 | AF245505 | Hs. 72157 | Homo sapiens adlican mRNA, complete cds | 34.3 |
| 410626 | BE407727 | | gb: 601299771F1 NIH_MGC_21 Homo sapiens cDNA | 34.2 |
| 410706 | AI732404 | Hs. 68846 | ESTs | 34.2 |
| 419273 | BE271180 | Hs. 293490 | ESTs | 34.2 |
| 407839 | AA045144 | Hs. 161566 | ESTs | 34.0 |
| 444286 | AI625304 | Hs. 190312 | ESTs | 34.0 |
| 449226 | AB002365 | Hs. 23311 | KIAA0367 protein | 34.0 |
| 414290 | AI568801 | Hs. 71721 | ESTs | 33.9 |
| 401245 | | | predicted exon | 33.9 |
| 425222 | M85430 | Hs. 155191 | villin 2 (ezrin) | 33.8 |
| 409950 | R42678 | Hs. 301669 | KIAA0564 protein | 33.8 |
| 437201 | F29279 | Hs. 177486 | amyloid beta (A4) precursor protein (protease nexin-II, | 33.7 |
| 406566 | AF088886 | Hs. 11590 | cathepsin F | 33.7 |
| 405071 | | | predicted exon | 33.7 |
| 455426 | AW937792 | | gb: QV3-DT0045-140200-082-b07 DT0045 Homo sapi | 33.6 |
| 415160 | T82802 | | gb: yd38a04.r1 Soares fetal liver spleen 1NFLS Homo s | 33.5 |
| 424995 | Z45023 | | gb: HSC2FA041 normalized infant brain cDNA Homo s | 33.5 |
| 453870 | AW385001 | Hs. 8042 | Homo sapiens cDNA FLJ23173 fis, clone LNG10019 | 33.5 |
| 433470 | AW960564 | Hs. 3337 | transmembrane 4 superfamily member 1 | 33.4 |
| 428188 | M98447 | Hs. 22 | transglutaminase 1 (K polypeptide epidermal type I, pro | 33.3 |
| 417409 | BE272506 | Hs. 82109 | syndecan 1 | 33.3 |
| 425389 | AW974499 | Hs. 192183 | ESTs | 33.3 |
| 434658 | AI624436 | Hs. 194488 | ESTs | 33.2 |
| 456562 | AA306049 | Hs. 102669 | DKFZP434O125 protein | 33.1 |
| 447111 | AI017574 | Hs. 17409 | cysteine-rich protein 1 (intestinal) | 33.0 |
| 432360 | BE045243 | Hs. 274416 | NADH dehydrogenase (ubiquinone) 1 alpha subcomple | 32.9 |
| 424125 | M31669 | Hs. 1735 | inhibin, beta B (activin AB beta polypeptide) | 32.7 |
| 419968 | X04430 | Hs. 93913 | interleukin 6 (interferon, beta 2) | 32.7 |
| 429415 | NM_002593 | Hs. 202097 | procollagen C-endopeptidase enhancer | 32.6 |
| 451541 | BE279383 | Hs. 26557 | plakophilin 3 | 32.6 |
| 424499 | N90344 | Hs. 149436 | kinesin family member 5B | 32.4 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 402144 | | | predicted exon | 32.4 |
| 422511 | AU076442 | Hs. 117938 | collagen, type XVII, alpha 1 | 32.4 |
| 400231 | | | predicted exon | 32.3 |
| 437712 | X04588 | Hs. 85844 | neurotrophic tyrosine kinase, receptor, type 1 | 32.3 |
| 417433 | BE270266 | Hs. 82128 | 5T4 oncofetal trophoblast glycoprotein | 32.2 |
| 419659 | AB023206 | Hs. 92186 | Leman coiled-coil protein | 32.0 |
| 428582 | BE336699 | Hs. 185055 | BENE protein | 32.0 |
| 421401 | AW410478 | Hs. 104019 | transforming, acidic coiled-coil containing protein 3 | 32.0 |
| 414064 | BE245289 | Hs. 16165 | expressed in activated T/LAK lymphocytes | 32.0 |
| 431938 | AA938471 | Hs. 115242 | developmentally regulated GTP-binding protein 1 | 32.0 |
| 411930 | F06485 | | gb: HSC19G051 normalized infant brain cDNA Homo s | 31.9 |
| 428150 | AW950547 | Hs. 182684 | cytochrome c oxidase subunit VIIa polypeptide 2 (liver) | 31.8 |
| 401887 | | | predicted exon | 31.8 |
| 412570 | AA033517 | Hs. 74047 | electron-transfer-flavoprotein, beta polypeptide | 31.7 |
| 422738 | X80915 | Hs. 1573 | growth differentiation factor 5 (cartilage-derived morph | 31.6 |
| 453092 | X64838 | Hs. 31638 | restin (Reed-Steinberg cell-expressed intermediate filam | 31.5 |
| 413924 | AL119964 | Hs. 75616 | KIAA0018 gene product | 31.4 |
| 420231 | R06866 | Hs. 19813 | ESTs | 31.3 |
| 434715 | BE005346 | Hs. 116410 | ESTs | 31.3 |
| 422831 | R02504 | | gb: ye86f06.r1 Soares fetal liver spleen 1NFLS Homo sa | 31.2 |
| 416854 | H40164 | Hs. 80296 | Purkinje cell protein 4 | 31.2 |
| 422976 | AU076657 | Hs. 1600 | sec61 homolog | 31.1 |
| 426356 | BE536836 | | gb: 601064837F1 NIH_MGC_10 Homo sapiens cDNA | 31.0 |
| 433935 | AF112208 | Hs. 44163 | 13 kDa differentiation-associated protein | 30.8 |
| 430040 | AW503115 | Hs. 227823 | pM5 protein | 30.8 |
| 406340 | AA299679 | Hs. 180370 | cofilin 1 (non-muscle) | 30.8 |
| 426050 | AF017307 | Hs. 166096 | E74-like factor 3 (ets domain transcription factor, epith | 30.7 |
| 425105 | BE280066 | Hs. 24956 | hypothetical protein FLJ22056 | 30.7 |
| 402066 | | | predicted exon | 30.7 |
| 429538 | BE182592 | Hs. 139322 | small proline-rich protein 3 | 30.6 |
| 418371 | M13560 | Hs. 84298 | CD74 antigen (invariant polypeptide of major histocom | 30.4 |
| 421251 | Z28913 | Hs. 102948 | enigma (LIM domain protein) | 30.3 |
| 456084 | AA155859 | Hs. 79708 | ESTs | 30.3 |
| 402023 | | | predicted exon | 30.3 |
| 404356 | | | predicted exon | 30.2 |
| 415973 | R24707 | Hs. 260201 | ESTs | 30.2 |
| 445983 | AI269107 | Hs. 132219 | ESTs | 30.1 |
| 450440 | AB024334 | Hs. 25001 | tyrosine 3-monooxygenase/tryptophan 5-monooxygenas | 30.1 |
| 458789 | AL157468 | Hs. 20157 | Homo sapiens cDNA FLJ20848 fis, clone ADKA01732 | 30.1 |
| 400842 | | | predicted exon | 30.1 |
| 406828 | AA419202 | Hs. 84298 | CD74 antigen (invariant polypeptide of major histocom | 30.0 |
| 423267 | AL137416 | Hs. 126177 | Homo sapiens mRNA; cDNA DKFZp434O192 (from c | 30.0 |
| 451383 | AW239364 | Hs. 20242 | hypothetical protein FLJ12788 | 30.0 |
| 437042 | AK000702 | Hs. 5420 | hypothetical protein FLJ20695 | 30.0 |
| 459399 | BE407712 | | gb: 601299745F1 NIH_MGC_21 Homo sapiens cDNA | 30.0 |
| 425650 | NM_001944 | Hs. 1925 | desmoglein 3 (pemphigus vulgaris antigen) | 30.0 |
| 416511 | NM_006762 | Hs. 79356 | Lysosomal-associated multispanning membrane protein | 29.9 |
| 431009 | BE149762 | Hs. 248213 | gap junction protein, beta 6 (connexin 30) | 29.7 |
| 436651 | BE045962 | Hs. 275998 | ESTs | 29.6 |
| 419766 | BE243101 | Hs. 22391 | chromosome 20open reading frame 3 | 29.5 |
| 420747 | BE294407 | Hs. 99910 | phosphofructokinase, platelet | 29.5 |
| 436895 | AF037335 | Hs. 5338 | carbonic anhydrase XII | 29.5 |
| 412765 | AK000620 | Hs. 74571 | ADP-ribosylation factor 1 | 29.4 |
| 419223 | X60111 | Hs. 1244 | CD9 antigen (p24) | 29.4 |
| 413796 | AW408094 | Hs. 75545 | interleukin 4 receptor | 29.4 |
| 447795 | AW295151 | Hs. 163612 | ESTs | 29.4 |
| 431103 | M57399 | Hs. 44 | pleiotrophin (heparin binding growth factor 8, neurite g | 29.4 |
| 415314 | N88802 | Hs. 5422 | glycoprotein M6B | 29.3 |
| 428411 | AW291464 | Hs. 10338 | ESTs | 29.3 |
| 430580 | AA806105 | Hs. 140 | immunoglobulin heavy constant gamma 3 (Gm marker) | 29.3 |
| 430451 | AA836472 | Hs. 249982 | cathepsin B | 29.2 |
| 453949 | AU077146 | Hs. 36927 | heat shock 105 kD | 29.2 |
| 413859 | AW992356 | Hs. 8364 | pyruvate dehydrogenase kinase, isoenzyme 4 | 29.2 |
| 407845 | AL036518 | Hs. 118598 | ESTs | 29.1 |
| 453500 | AI478427 | Hs. 43125 | ESTs | 29.1 |
| 456054 | BE313241 | | gb: 601151545F1 NIH_MGC_19 Homo sapiens cDNA | 29.0 |
| 453467 | AI535997 | Hs. 30089 | ESTs | 29.0 |
| 411794 | AL118577 | Hs. 75658 | phosphorylase, glycogen, brain | 28.9 |
| 421773 | W69233 | Hs. 112457 | ESTs | 28.9 |
| 423621 | BE002904 | | gb: QV4-BN0090-070400-163-c07 BN0090 Homo sapi | 28.8 |
| 408935 | BE539706 | Hs. 285363 | ESTs | 28.8 |
| 450847 | NM_003155 | Hs. 25590 | stanniocalcin 1 | 28.8 |
| 431243 | U46455 | Hs. 252189 | syndecan 4 (amphiglycan, ryudocan) | 28.7 |
| 423225 | AA852604 | Hs. 125359 | Thy-1 cell surface antigen | 28.7 |
| 433469 | F12741 | | gb: HSC3DG061 normalized infant brain cDNA Homo | 28.7 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 405783 | | | predicted exon | 28.7 |
| 417308 | H60720 | Hs. 81892 | KIAA0101 gene product | 28.7 |
| 400749 | | | predicted exon | 28.7 |
| 413442 | BE140643 | | gb: RC0-HT0015-310599-016 HT0015 Homo sapiens c | 28.6 |
| 404828 | | | predicted exon | 28.6 |
| 407453 | AJ132087 | | gb: Homo sapiens mRNA for axonemal dynein heavy ch | 28.6 |
| 418529 | AW005695 | Hs. 250897 | TRK-fused gene (NOTE non-standard symbol and nam | 28.6 |
| 413787 | AI352558 | Hs. 75544 | tyrosine 3-monooxygenase/tryptophan 5-monooxygenas | 28.5 |
| 450690 | AA296696 | Hs. 25334 | FXYD domain-containing ion transport regulator 5 | 28.5 |
| 402430 | | | predicted exon | 28.4 |
| 413929 | BE501689 | Hs. 75617 | collagen, type IV, alpha 2 | 28.2 |
| 423803 | NM_005709 | Hs. 132945 | PDZ-73 protein | 28.2 |
| 406086 | | | predicted exon | 28.2 |
| 416585 | X54162 | Hs. 79386 | leiomodin 1 (smooth muscle) | 28.2 |
| 417055 | N39489 | Hs. 7258 | Homo sapiens cDNA FLJ22021 fis, clone HEP08253 | 28.1 |
| 449184 | AW296295 | Hs. 196491 | ESTs | 28.1 |
| 446542 | NM_004281 | Hs. 15259 | BCL2-associated athanogene 3 | 28.1 |
| 412793 | AW997986 | | gb: RC1-BN0056-230200-021-e11 BN0056 Homo sapie | 28.0 |
| 452818 | W21909 | Hs. 8372 | ubiquinol-cytochrome c reductase (6.4 kD) subunit | 28.0 |
| 402869 | | | predicted exon | 27.9 |
| 436810 | AA353044 | Hs. 5321 | ARP3 (actin-related protein 3, yeast) homolog | 27.9 |
| 402075 | | | predicted exon | 27.9 |
| 410480 | R97457 | Hs. 63984 | cadherin 13, H-cadherin (heart) | 27.8 |
| 406690 | M29540 | Hs. 220529 | carcinoembryonic antigen-related cell adhesion molecul | 27.8 |
| 439766 | AB033492 | Hs. 301241 | Homo sapiens mRNA, cDNA DKFZp586A0424 (from | 27.7 |
| 424482 | BE268621 | Hs. 149155 | voltage-dependent anion channel 1 | 27.6 |
| 420737 | L08096 | Hs. 99899 | tumor necrosis factor (ligand) superfamily, member 7 | 27.6 |
| 414663 | BE396326 | | gb: 601289258F1 NIH_MGC_8 Homo sapiens cDNA c | 27.6 |
| 409703 | NM_006187 | Hs. 56009 | 2'–5'oligoadenylate synthetase 3 | 27.6 |
| 446108 | AL036596 | Hs. 102773 | ESTs | 27.5 |
| 428144 | BE269243 | Hs. 182625 | VAMP (vesicle-associated membrane protein)-associate | 27.5 |
| 445688 | AI248205 | Hs. 153244 | ESTs | 27.5 |
| 405411 | | | predicted exon | 27.5 |
| 410275 | U85658 | Hs. 61796 | transcription factor AP-2 gamma (activating enhancer-b | 27.5 |
| 424675 | NM_005512 | Hs. 151641 | glycoprotein A repetitions predominant | 27.3 |
| 450455 | AL117424 | Hs. 25035 | chloride intracellular channel 4 | 27.3 |
| 414855 | AA156986 | Hs. 104640 | HIV-1 inducer of short transcripts binding protein | 27.2 |
| 433578 | BE336886 | Hs. 3416 | adipose differentiation-related protein | 27.2 |
| 401994 | | | predicted exon | 27.2 |
| 445033 | AV652402 | Hs. 155145 | ESTs | 27.2 |
| 402277 | | | predicted exon | 27.1 |
| 428106 | BE620016 | Hs. 182470 | PTD010 protein | 27.1 |
| 448625 | AW970786 | Hs. 178470 | Homo sapiens cDNA FLJ22662 fis, clone HSI08080 | 27.1 |
| 422587 | AI879352 | Hs. 118625 | hexokinase 1 | 27.0 |
| 457204 | BE264152 | Hs. 221994 | ESTs | 27.0 |
| 444094 | AI695764 | Hs. 202394 | ESTs | 27.0 |
| 414053 | BE391635 | Hs. 75725 | transgelin 2 | 26.9 |
| 430511 | BE018156 | Hs. 2575 | calpain 1, (mu/l) large subunit | 26.9 |
| 434039 | L32977 | Hs. 3712 | ubiquinol-cytochrome c reductase, Rieske iron-sulfur po | 26.9 |
| 424939 | AK000059 | Hs. 153881 | Homo sapiens NY-REN-62 antigen mRNA, partial cds | 26.9 |
| 414539 | BE379046 | | gb: 601236646F1 NIH_MGC_44 Homo sapiens cDNA | 26.9 |
| 404675 | | | predicted exon | 26.8 |
| 401597 | AA172106 | Hs. 110950 | Rag C protein | 26.8 |
| 401405 | | | predicted exon | 26.8 |
| 411541 | W03940 | | gb: za62b02.r1 Soares fetal liver spleen 1NFLS Homo sa | 26.8 |
| 412025 | AI827451 | Hs. 24143 | ESTs | 26.7 |
| 414276 | BE297862 | | gb: 601174780F1 NIH_MGC_17 Homo sapiens cDNA | 26.7 |
| 444065 | AW449415 | Hs. 10260 | Homo sapiens cDNA FLJ11341 fis, clone PLACE1010 | 26.7 |
| 447981 | R53772 | Hs. 8929 | hypothetical protein FLJ11362 | 26.7 |
| 410677 | NM_003278 | Hs. 65424 | tetranectin (plasminogen-binding protein) | 26.5 |
| 400982 | | | predicted exon | 26.5 |
| 452933 | AW391423 | Hs. 288555 | Homo sapiens cDNA FLJ22425 fis, clone HRC08686 | 26.5 |
| 407233 | X16354 | Hs. 50964 | carcinoembryonic antigen-related cell adhesion molecul | 26.4 |
| 430127 | AA219498 | Hs. 233952 | proteasome (prosome, macropain) subunit, alpha type, 7 | 26.3 |
| 448218 | AI188489 | | gb: qd09b12x1 Soares_placenta_8to9weeks_2NbHP8to | 26.3 |
| 413511 | AI627178 | Hs. 75412 | Arginine-rich protein | 26.2 |
| 459511 | AI142379 | | gb: qg64c01.r1 Soares_testis_NHT Homo sapiens cDNA | 26.2 |
| 410668 | BE379794 | Hs. 65403 | hypothetical protein | 26.2 |
| 458662 | AI823410 | Hs. 169149 | karyopherin alpha 1 (importin alpha 5) | 26.2 |
| 451219 | AA054209 | Hs. 167904 | ESTs | 26.2 |
| 448939 | BE267795 | Hs. 22595 | hypothetical protein FLJ10637 | 26.2 |
| 400800 | Y10262 | Hs. 46925 | eyes absent (Drosophila) homolog 3 | 26.2 |
| 446342 | BE298665 | Hs. 14846 | Homo sapiens mRNA; cDNA DKFZp564D016 (from c | 26.2 |
| 421177 | AW070211 | Hs. 102415 | Homo sapiens mRNA; cDNA DKFZp586N0121 (from | 26.1 |
| 433848 | AF095719 | Hs. 93764 | carboxypeptidase A3 | 26.1 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 448497 | BE613269 | Hs. 21893 | ESTs, Weakly similar to glycerol 3-phosphate permease | 26.1 |
| 415279 | F04237 | Hs. 1447 | glial fibrillary acidic protein | 26.0 |
| 419323 | AI092379 | Hs. 135275 | ESTs | 26.0 |
| 430265 | L36033 | Hs. 237356 | stromal cell-derived factor 1 | 25.9 |
| 437679 | NM_014214 | Hs. 5753 | inositol(myo)-1(or 4)-monophosphatase 2 | 25.9 |
| 425535 | AB007937 | Hs. 158287 | KIAA0468 gene product | 25.8 |
| 412923 | AA179922 | Hs. 75056 | adaptor-related protein complex 3, delta 1 subunit | 25.8 |
| 447980 | AI703397 | Hs. 202355 | ESTs | 25.8 |
| 419118 | AA234223 | Hs. 139204 | ESTs | 25.8 |
| 421224 | AW402154 | Hs. 125812 | ESTs | 25.8 |
| 414890 | BE281095 | Hs. 77573 | uridine phosphorylase | 25.8 |
| 447330 | BE279949 | Hs. 18141 | ladinin 1 | 25.7 |
| 405610 | | | predicted exon | 25.7 |
| 447604 | AW089933 | Hs. 293674 | ESTs | 25.7 |
| 445677 | H96577 | Hs. 6838 | ras homolog gene family, member E | 25.7 |
| 456088 | BE177320 | Hs. 156148 | *Homo sapiens* cDNA FLJ23082 fis, clone LNG06451 | 25.7 |
| 417120 | N79687 | Hs. 46616 | ESTs | 25.6 |
| 405194 | | | predicted exon | 25.6 |
| 410687 | U24389 | Hs. 65436 | lysyl oxidase-like 1 | 25.6 |
| 421888 | AA299780 | Hs. 121036 | ESTs | 25.6 |
| 420459 | AF016045 | Hs. 97905 | ovo (Drosophila) homolog-like 1 | 25.5 |
| 416323 | N72630 | Hs. 33981 | *Homo sapiens* genomic DNA, chromosome 21q, section | 25.5 |
| 446292 | AF081497 | Hs. 279682 | Rh type C glycoprotein | 25.5 |
| 416274 | AW160404 | Hs. 79126 | guanine nucleotide binding protein 10 | 25.5 |
| 430028 | BE564110 | Hs. 227750 | NADH dehydrogenase (ubiquinone) 1 beta subcomplex | 25.5 |
| 438450 | AI050866 | Hs. 65853 | nodal, mouse, homolog | 25.5 |
| 400215 | | | predicted exon | 25.4 |
| 430014 | H59354 | Hs. 182485 | actinin, alpha 4 | 25.4 |
| 453582 | AW854339 | Hs. 33476 | hypothetical protein FLJ11937 | 25.4 |
| 405867 | | | predicted exon | 25.4 |
| 459170 | AI905518 | | gb: RC-BT091-210199-098 BT091 *Homo sapiens* cDNA | 25.4 |
| 407944 | R34008 | Hs. 239727 | desmocollin 2 | 25.4 |
| 415748 | D90086 | Hs. 979 | pyruvate dehydrogenase (lipoamide) beta | 25.3 |
| 423287 | H38340 | | gb: yp70h07 r1 Soares adult brain N2b4HB55Y Homo s | 25.3 |
| 450944 | AA554989 | Hs. 209061 | sudD (suppressor of bimD6, Aspergillus nidulans) homo | 25.3 |
| 432906 | BE265489 | Hs. 3123 | lethal giant larvae (Drosophila) homolog 2 | 25.3 |
| 400104 | | | predicted exon | 25.3 |
| 449019 | AI949095 | Hs. 67776 | ESTs, Weakly similar to ALU7_HUMAN ALU SUBFA | 25.3 |
| 406897 | M57417 | | gb: *Homo sapiens* mucin (mucin) mRNA, partial cds | 25.3 |
| 402639 | | | predicted exon | 25.3 |
| 447147 | AA910353 | Hs. 292815 | ESTs | 25.3 |
| 453379 | AA035261 | Hs. 61753 | ESTs | 25.3 |
| 414217 | AI309298 | Hs. 279898 | *Homo sapiens* cDNA: FLJ23165 fis, clone LNG09846 | 25.3 |
| 430223 | NM_002514 | Hs. 235935 | nephroblastoma overexpressed gene | 25.3 |
| 406685 | M18728 | | gb: Human nonspecific crossreacting antigen mRNA, co | 25.3 |
| 444747 | AW450407 | Hs. 257291 | ESTs, Weakly similar to PSS8_HUMAN PROSTASIN | 25.2 |
| 417883 | R22519 | Hs. 23398 | ESTs | 25.2 |
| 430235 | BE268048 | Hs. 236494 | RAB10, member RAS oncogene family | 25.2 |
| 459001 | AI761313 | Hs. 204605 | ESTs | 25.2 |
| 434368 | AW519020 | Hs. 212640 | *Homo sapiens* cDNA FLJ13265 fis, clone OVARC1000 | 25.2 |
| 415917 | Z43912 | | gb: HSC1OA111 normalized infant brain cDNA Homo | 25.2 |
| 444409 | AI792140 | Hs. 49265 | ESTs | 25.2 |
| 428578 | BE391797 | Hs. 82148 | hypothetical protein | 25.1 |
| 433417 | AA587773 | Hs. 136494 | ESTs | 25.1 |
| 426372 | BE304680 | Hs. 169531 | DEAD/H (Asp-Glu-Ala-Asp/His) box polypeptide 21 | 25.1 |
| 402131 | | | predicted exon | 25.1 |
| 450545 | AW135582 | Hs. 201767 | ESTs | 25.0 |
| 434162 | AI221214 | Hs. 116136 | ESTs | 25.0 |
| 406571 | | | predicted exon | 24.9 |
| 427600 | AW630918 | Hs. 179774 | proteasome (prosome, macropain) activator subunit 2 (P | 24.9 |
| 409402 | AF208234 | Hs. 695 | cystatin B (stefin B) | 24.9 |
| 400135 | | | predicted exon | 24.9 |
| 428403 | AI393048 | Hs. 239894 | leucine rich repeat (in FLII) interacting protein 1 | 24.9 |
| 403223 | | | predicted exon | 24.8 |
| 435236 | T03890 | Hs. 157208 | ESTs, Highly similar to Arx homeoprotein [M. musculu | 24.8 |
| 457439 | AW410408 | Hs. 271167 | L-pipecolic acid oxidase | 24.8 |
| 448667 | Z78394 | Hs. 4896 | *Homo sapiens* cDNA; FLJ22046 fis, clone HEP09276 | 24.8 |
| 440605 | Z40094 | Hs. 185698 | ESTs | 24.8 |
| 426724 | AA383623 | Hs. 293616 | ESTs | 24.8 |
| 403359 | | | predicted exon | 24.7 |
| 442826 | AI018777 | Hs. 131241 | ESTs | 24.7 |
| 411503 | AW190338 | Hs. 28029 | purinergic receptor P2X, ligand-gated ion channel, 4 | 24.6 |
| 414540 | BE379050 | | gb: 601236655F1 NIH_MGC_44 *Homo sapiens* cDNA | 24.6 |
| 421595 | AB014520 | Hs. 105958 | *Homo sapiens* cDNA: FLJ22735 fis, clone HUV00180 | 24.5 |
| 438802 | AA825976 | Hs. 136954 | ESTs | 24.5 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 400491 | H25530 | Hs. 50868 | solute carrier family 22 (organic cation transporter), me | 24.5 |
| 418994 | AA296520 | Hs. 89546 | selectin E (endothelial adhesion molecule 1) | 24.5 |
| 426383 | BE537380 | | gb: 601064570F1 NIH_MGC_10 Homo sapiens cDNA | 24.4 |
| 418408 | AA219321 | Hs. 173294 | ESTs | 24.4 |
| 416186 | W87575 | Hs. 269177 | ESTs | 24.4 |
| 416908 | AA333990 | Hs. 80424 | coagulation factor XIII, A1 polypeptide | 24.4 |
| 453857 | AL080235 | Hs. 35861 | DKFZP586E1621 protein | 24.4 |
| 439706 | AW872527 | Hs. 59761 | ESTs | 24.4 |
| 441619 | NM_014056 | Hs. 7917 | DKFZP564K247 protein | 24.4 |
| 417198 | F11533 | Hs. 81634 | ATP synthase, H+ transporting, mitochondrial F0 comp | 24.3 |
| 433662 | W07162 | Hs. 150826 | CATX-8 protein | 24.3 |
| 453986 | M13232 | Hs. 36989 | coagulation factor VII (serum prothrombin conversion a | 24.3 |
| 457123 | AA770021 | Hs. 16332 | ESTs | 24.3 |
| 433864 | AA931550 | Hs. 192785 | ESTs | 24.3 |
| 409865 | AW502208 | | gb: UI-HF-BR0p-aju-e-09-0-UI_r1 NIH_MGC_52 Hom | 24.3 |
| 448175 | BE296174 | Hs. 225160 | Homo sapiens cDNA FLJ13102 fis, clone NT2RP3002 | 24.3 |
| 406277 | | | predicted exon | 24.3 |
| 451957 | AI796320 | Hs. 10299 | Homo sapiens cDNA FLJ13545 fis, clone PLACE1006 | 24.3 |
| 408802 | AL048269 | Hs. 288544 | Homo sapiens cDNA FLJ20882 fis, clone ADKA0320 | 24.2 |
| 401757 | | | predicted exon | 24.2 |
| 444751 | AI207406 | Hs. 11866 | hypothetical protein PRO1197 | 24.2 |
| 408647 | AW245831 | | gb: 2822937.5prime NIH_MGC_7 Homo sapiens cDNA | 24.2 |
| 418870 | AF147204 | Hs. 89414 | chemokine (C-X-C motif), receptor 4 (fusin) | 24.2 |
| 436913 | AA789074 | Hs. 187478 | ESTs | 24.2 |
| 434745 | AW974445 | Hs. 185155 | ESTs, Weakly similar to HuEMAP [H. sapiens] | 24.2 |
| 451743 | AW074266 | Hs. 23071 | ESTs | 24.2 |
| 421853 | AL117472 | Hs. 108924 | DKFZP586P1422 protein | 24.2 |
| 407926 | AW956382 | Hs. 59771 | ESTs | 24.1 |
| 413973 | BE279858 | Hs. 128417 | Homo sapiens cDNA FLJ14009 fis, clone Y79AA1002 | 24.1 |
| 439078 | AF085936 | | gb: Homo sapiens full length insert cDNA clone YR58F | 24.1 |
| 401913 | | | predicted exon | 24.1 |
| 435138 | BE314734 | | gb: 601152976F1 NIH_MGC_19 Homo sapiens cDNA | 24.1 |
| 405311 | | | predicted exon | 24.0 |
| 413127 | BE066529 | Hs. 83484 | SRY (sex determining region Y)-box 4 | 24.0 |
| 430793 | M83181 | Hs. 247940 | 5-hydroxytryptamine (serotonin) receptor 1A | 24.0 |
| 434445 | AI349306 | Hs. 11782 | ESTs | 24.0 |
| 418166 | AI754416 | Hs. 260024 | Cdc42 effector protein 3 | 24.0 |
| 431971 | BE274907 | Hs. 77385 | myosin, light polypeptide 6, alkali, smooth muscle and n | 23.9 |
| 401167 | | | predicted exon | 23.9 |
| 454163 | AW175997 | | gb: QV0-BT0078-190899-005-E02 BT0078 Homo sapi | 23.9 |
| 403306 | NM_006825 | Hs. 74368 | transmembrane protein (63 kD), endoplasmic reticulum/ | 23.9 |
| 410627 | AA181339 | Hs. 929 | myosin, heavy polypeptide 7, cardiac muscle, beta | 23.9 |
| 450796 | NM_001988 | Hs. 25482 | envoplakin | 23.8 |
| 442199 | BE277633 | Hs. 286027 | etoposide-induced mRNA | 23.8 |
| 402699 | | | predicted exon | 23.8 |
| 426143 | BE379836 | Hs. 167106 | proteasome (prosome, macropain) subunit, alpha type, 3 | 23.8 |
| 437592 | NM_003851 | Hs. 5710 | cellular repressor of E1A-stimulated genes | 23.8 |
| 433598 | AI762836 | Hs. 271433 | ESTs, Moderately similar to ALU2_HUMAN ALU SU | 23.8 |
| 401088 | | | predicted exon | 23.8 |
| 445924 | AI264671 | Hs. 164166 | ESTs | 23.8 |
| 420902 | AA742277 | | gb: ny28e09.s1 NCI_CGAP_GCB1 Homo sapiens cDN | 23.8 |
| 426369 | AF134157 | Hs. 169487 | Kreisler (mouse) maf-related leucine zipper homolog | 23.8 |
| 458698 | AW452189 | Hs. 257528 | ESTs | 23.7 |
| 422048 | NM_012445 | Hs. 288126 | spondin 2, estracellular matrix protein | 23.7 |
| 413460 | R61610 | Hs. 21527 | ESTs, Weakly similar to KIAA0918 protein [H. sapiens | 23.6 |
| 401575 | | | predicted exon | 23.6 |
| 431822 | AA516049 | | gb: ng65d01.s1 NCI_CGAP_Lip2 Hamo sapiens cDNA | 23.6 |
| 427276 | A4400269 | Hs. 49598 | ESTs | 23.6 |
| 417069 | AA442192 | Hs. 81097 | cytochrome c oxidase subunit VIII | 23.5 |
| 400161 | | | predicted exon | 23.5 |
| 417190 | NM_001359 | Hs. 81548 | 2,4-dienoyl CoA reductase 1, mitochondrial | 23.5 |
| 443667 | AI129066 | Hs. 135457 | ESTs | 23.5 |
| 413544 | BE147225 | | gb: PM2-HT0225-031299-003-f11 HT0225 Homo sapie | 23.5 |
| 400685 | | | predicted exon | 23.5 |
| 422090 | W05345 | Hs. 293884 | ESTs | 23.4 |
| 432517 | AF275816 | Hs. 283096 | PR domain containing 9 | 23.4 |
| 405307 | | | predicted exon | 23.4 |
| 416328 | H48389 | Hs. 268886 | ESTs | 23.4 |
| 427174 | AA398848 | Hs. 97541 | ESTs | 23.4 |
| 426148 | AI751071 | Hs. 167135 | Homo sapiens cDNA FLJ10728 fis, clone NT2RP3001 | 23.3 |
| 452544 | AW851888 | | gb: QV0-CT0225-131099-034-d05 CT0225 Homo sapie | 23.3 |
| 404890 | | | predicted exon | 23.3 |
| 408725 | AA131539 | Hs. 15669 | ESTs | 23.3 |
| 428362 | AA426555 | Hs. 169333 | ESTs | 23.3 |
| 425349 | AA425234 | Hs. 79886 | nbose 5-phosphate isomerase A (ribose 5-phosphate ep | 23.3 |

TABLE 3A-continued

ABOUT 1643 UP-REGULATED GENES, OVARIAN CANCER VERSUS NORMAL OVARY

| Pkey | Ex Accn No. | UG ID | Title | ratio |
| --- | --- | --- | --- | --- |
| 422440 | NM_004812 | Hs. 116724 | aldo-keto reductase family 1, member B11 (aldose redu | 23.3 |
| 410962 | BE273749 | Hs. 752 | FK506-binding protein 1A (12 kD) | 23.2 |
| 411796 | AA807197 | Hs. 6918 | ESTs | 23.2 |
| 458954 | AW379075 | Hs. 141742 | *Homo sapiens* cDNA FLJ12211 fis, clone MAMMA10 | 23.2 |
| 408896 | AI610447 | Hs. 48778 | niban protein | 23.2 |
| 457024 | AA397546 | Hs. 119151 | ESTs | 23.2 |
| 414591 | AI888490 | Hs. 55902 | ESTs | 23.2 |
| 437846 | AA773866 | Hs. 244569 | ESTs | 23.2 |
| 401220 | | | predicted exon | 23.1 |
| 421747 | AI816224 | Hs. 107747 | DKFZP566C243 protein | 23.1 |
| 452950 | AA428123 | Hs. 7745 | 17 kD fetal brain protein | 23.1 |
| 414327 | BE408145 | Hs. 185254 | ESTs, Moderately similar to NAC-1 protein [norvegic | 23.1 |
| 405256 | | | predicted exon | 23.1 |
| 452416 | AA026115 | Hs. 114777 | ESTs | 23.1 |
| 440684 | AI253123 | Hs. 127356 | ESTs, Highly similar to NEST_HUMAN NESTI [H. sap | 23.1 |
| 445603 | H08345 | Hs. 106234 | ESTs | 23.1 |
| 436306 | AA805939 | Hs. 117927 | ESTs | 23.1 |
| 434867 | AF159442 | Hs. 103382 | phospholipid scramblase 3 | 23.0 |
| 404727 | | | predicted exon | 23.0 |
| 407317 | AI204033 | Hs. 271461 | ESTs, Weakly similar to ALU5_HUMAN ALU SUBFA | 23.0 |
| 405580 | | | predicted exon | 23.0 |
| 437898 | W81260 | Hs. 43410 | ESTs | 22.9 |
| 448781 | AW243419 | Hs. 254048 | ESTs | 22.9 |
| 457297 | AW968188 | Hs. 290999 | ESTs | 22.9 |
| 405545 | | | predicted exon | 22.9 |
| 431562 | AI884334 | Hs. 11637 | ESTs | 22.9 |
| 440703 | AL137663 | Hs. 7378 | *Homo sapiens* mRNA, cDNA DKFZp434G227 (from c | 22.9 |
| 439848 | AW979249 | | gb: EST391359 MAGE resequences, MAGP Homo sap | 22.9 |
| 418149 | AA811473 | Hs. 291877 | ESTs | 22.9 |
| 439332 | AW842747 | Hs. 293314 | ESTs, Highly similar to unnamed protein product [H. sa | 22.8 |
| 401566 | | | predicted exon | 22.8 |
| 425078 | NM_002599 | Hs. 154437 | phosphodiesterase 2A, cGMP-stimulated | 22.8 |
| 406684 | X16354 | Hs. 50964 | carcinoembryonic antigen-related cell adhesion molecul | 22.8 |
| 421651 | AW860612 | Hs. 283586 | ESTs | 22.8 |
| 421064 | AI245432 | Hs. 101382 | tumor necrosis factor, alpha-induced protein 2 | 22.8 |
| 441249 | AA971585 | Hs. 166250 | ESTs | 22.8 |
| 457624 | AA809159 | Hs. 287581 | *Homo sapiens* cDNA FLJ13544 fis, clone PLACE1006 | 22.8 |
| 407395 | AF005082 | | gb: *Homo sapiens* skin-specific protein (xp33) mRNA, p | 22.8 |
| 459006 | AW298631 | Hs. 27721 | hypothetical protein FLJ20353 | 22.8 |
| 436827 | H72187 | Hs. 5322 | guanine nucleotide binding protein (G protein), gamma | 22.7 |
| 418174 | L20688 | Hs. 83656 | Rho GDP dissociation inhibitor (GDI) beta | 22.7 |
| 418307 | U70867 | Hs. 83974 | solute carrier family 21 (prostaglandin transporter), mem | 22.7 |
| 456035 | N54956 | Hs. 271726 | ESTs | 22.7 |
| 457867 | AA045767 | Hs. 5300 | bladder cancer associated protein | 22.7 |
| 440401 | AI126341 | Hs. 143887 | ESTs | 22.7 |
| 400126 | | | predicted exon | 22.7 |
| 414931 | AK000342 | Hs. 77646 | *Homo sapiens* mRNA, cDNA DKFZp761M0223 (from | 22.7 |
| 406719 | AI832962 | Hs. 169476 | glyceraldehyde-3-phosphate dehydrogenase | 22.6 |
| 439675 | W95357 | Hs. 138860 | Rho GTPase activating protein 1 | 22.6 |
| 456058 | N94587 | Hs. 55063 | ESTs | 22.6 |
| 441926 | AI015051 | Hs. 130953 | ESTs | 22.6 |
| 428423 | AU076517 | Hs. 184276 | solute carrier family 9 (sodium/hydrogen exchanger), is | 22.6 |
| 438518 | BE561958 | Hs. 285823 | immunoglobulin heavy constant mu | 22.6 |
| 420674 | NM_000055 | Hs. 1327 | butyrylcholinesterase | 22.6 |
| 422160 | AW582898 | | gb: ia07e04.y1 Human Pancreatic Islets *Homo sapiens* c | 22.5 |
| 412408 | D51103 | Hs. 73851 | ATP synthase, H+ transporting, mitochondrial F0 comp | 22.5 |
| 400964 | | | predicted exon | 22.5 |
| 434360 | AW015415 | Hs. 127780 | ESTs | 22.5 |
| 427977 | AW630727 | Hs. 181307 | H3 histone, family 3A | 22.4 |
| 450339 | AI693281 | Hs. 54547 | ESTs | 22.4 |
| 424059 | AW451266 | Hs. 107418 | ESTs | 22.4 |
| 414626 | BE410589 | | gb: 601303308F1 NIH_MGC_21 *Homo sapiens* cDNA | 22.4 |
| 401991 | | | predicted exon | 22.4 |
| 419741 | NM_007019 | Hs. 93002 | ubiquitin carrier protein E2-C | 22.3 |
| 457952 | U25750 | Hs. 210783 | Human chromosome 17q21 mRNA clone 1046.1-1 | 22.3 |
| 422597 | BE245909 | Hs. 118634 | ATP-binding cassette, sub-family B (MDR/TAP), mem | 22.3 |
| 429504 | X99133 | Hs. 204238 | lipocalin 2 (oncogene 24p3) | 22.3 |
| 447306 | AI373163 | Hs. 170333 | ESTs | 22.3 |
| 424966 | AU077312 | Hs. 153985 | solute carrier family 7 (cationic amino acid transporter, | 22.3 |
| 422739 | H20106 | Hs. 119591 | adaptor-related protein complex 2, sigma 1 subunit | 22.2 |
| 432504 | AL121015 | Hs. 277704 | oxygen regulated protein (150 kD) | 22.2 |
| 423804 | AW403448 | Hs. 1706 | interferon-stimulated transcription factor 3, gamma (48 k | 22.2 |
| 404683 | AI924294 | Hs. 173259 | uncharacterized bone marrow protein BM033 | 22.2 |
| 441624 | AF220191 | Hs. 179666 | uncharacterized hypothalamas protein HSMNP1 | 22.2 |
| 425751 | T19239 | Hs. 1940 | crystallin, alpha B | 22.2 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 452976 | R44214 | Hs. 101189 | ESTs | 22.2 |
| 414642 | AA150350 | | gb: zl03h01.r1 Soares_pregnant_uterus_NbHPU Homo | 22.2 |
| 437452 | AL390127 | Hs. 7104 | *Homo sapiens* mRNA; cDNA DKFZp761P06121 (from | 22.2 |
| 417426 | NM_002291 | Hs. 82124 | laminin, beta 1 | 22.2 |
| 414774 | X02419 | Hs. 77274 | plasminogen activator, urokinase | 22.1 |
| 424631 | AA688021 | Hs. 179808 | ESTs | 22.1 |
| 413967 | AW204431 | Hs. 117853 | ESTs | 22.1 |
| 400174 | | | predicted exon | 22.1 |
| 431837 | T79326 | Hs. 298262 | ESTs, Weakly similar to dJ88J8.1 [*H. sapiens*] | 22.1 |
| 401628 | | | predicted exon | 22.1 |
| 418374 | AJ011916 | Hs. 84359 | hypothetical protein | 22.0 |
| 429297 | X82494 | Hs. 198862 | fibulin 2 | 22.0 |
| 403508 | | | predicted exon | 22.0 |
| 432638 | AI017717 | Hs. 126525 | chromosome 21 open reading frame 15 | 22.0 |
| 407382 | AA503620 | | gb: ne49b08.s1 NCI_CGAP_Co3 *Homo sapiens* cDNA | 22.0 |
| 411492 | T46848 | Hs. 70337 | immunoglobulin superfamily, member 4 | 22.0 |
| 420185 | AL044056 | Hs. 158047 | ESTs | 22.0 |
| 409545 | BE296182 | | gb: 601177324F1 NIH_MGC_17 *Homo sapiens* cDNA | 22.0 |
| 426662 | AA879474 | Hs. 122710 | ESTs | 22.0 |
| 424247 | X14008 | Hs. 234734 | lysozyme (renal amyloidosis) | 22.0 |
| 443062 | N77999 | Hs. 8963 | *Homo sapiens* mRNA full length insert cDNA clone EU | 21.9 |
| 422447 | AA310711 | Hs. 124340 | ESTs | 21.9 |
| 421574 | AJ000152 | Hs. 105924 | defensin, beta 2 | 21.9 |
| 435302 | AI076259 | Hs. 190337 | ESTs | 21.9 |
| 414527 | BE241739 | Hs. 76359 | catalase | 21.9 |
| 441436 | AW137772 | Hs. 185980 | ESTs | 21.9 |
| 454178 | AW177274 | | gb: CM2-CT0128-230899-005-a02 CT0128 Homo sapie | 21.8 |
| 448838 | BE614761 | | gb: 601281335F1 NIH_MGC_39 *Homo sapiens* cDNA | 21.8 |
| 427889 | AI400968 | Hs. 181046 | dual specificity phosphatase 3 (vaccinia virus phosphat | 21.8 |
| 441114 | AA917466 | Hs. 126600 | ESTs | 21.8 |
| 451831 | NM_001674 | Hs. 460 | activating transcription factor 3 | 21.8 |
| 405600 | | | predicted exon | 21.8 |
| 446981 | AI652743 | Hs. 197497 | ESTs | 21.8 |
| 432839 | AA579465 | Hs. 287332 | ESTs | 21.8 |
| 405208 | | | predicted exon | 21.8 |
| 435025 | T08990 | Hs. 4742 | anchor attachment protein 1 (Gaa1p, yeast) homolog | 21.7 |
| 413976 | BE295452 | Hs. 75655 | procollagen-proline, 2-oxoglutarate 4-dioxygenase (pro | 21.7 |
| 423515 | AA327017 | Hs. 162204 | ESTs | 21.7 |
| 452329 | N36626 | Hs. 29106 | mitogen-activated protein kinase phosphatase x | 21.7 |
| 423050 | AA320946 | | gb: EST23529 Adipose tissue, brown *Homo sapiens* cD | 21.7 |
| 413679 | BE156765 | | gb: RC1-HT0370-120100-012-c09 HT0370 Homo sapie | 21.7 |
| 442166 | AW845280 | Hs. 204723 | ESTs | 21.6 |
| 445585 | AI243836 | Hs. 147066 | ESTs | 21.6 |
| 406160 | | | predicted exon | 21.6 |
| 433025 | AA374743 | Hs. 279920 | tyrosine 3-monooxygenase/tryptophan 5-monooxygenas | 21.6 |
| 446598 | AW250546 | | gb: 2821774.5prime NIH_MGC_7 *Homo sapiens* cDNA | 21.6 |
| 434493 | AA635305 | Hs. 121574 | ESTs | 21.6 |
| 429582 | AI569068 | Hs. 22247 | ESTs | 21.6 |
| 403796 | | | predicted exon | 21.6 |
| 405028 | | | predicted exon | 21.6 |
| 426597 | AA382250 | Hs. 145601 | ESTs | 21.6 |
| 437308 | AA749417 | Hs. 292353 | ESTs | 21.6 |
| 447384 | AI377221 | Hs. 40528 | ESTs | 21.6 |
| 429060 | AW139155 | Hs. 194995 | hypothetical protein DKFZp434O0320 | 21.6 |
| 437068 | AA743643 | Hs. 291427 | ESTs | 21.6 |
| 418509 | AB028624 | Hs. 85539 | ATP synthase, H+ transporting, mitochondrial F0 comp | 21.5 |
| 432999 | BE294029 | Hs. 279903 | Ras homolog enriched in brain 2 | 21.5 |
| 407663 | NM_016429 | Hs. 37482 | COPZ2 for nonclathrin cost protein zeta-COP | 21.5 |
| 446627 | AI973016 | Hs. 15725 | hypothetical protein SBBI48 | 21.5 |
| 413605 | BE152644 | | gb: CM1-HT0329-250200-128-f09 HT0329 Homo sapie | 21.5 |
| 427286 | AW732802 | Hs. 2132 | epidermal growth factor receptor pathway substrate 8 | 21.5 |
| 405226 | | | predicted exon | 21.4 |
| 402570 | | | predicted exon | 21.4 |
| 457960 | AA771881 | Hs. 298149 | ESTs | 21.4 |
| 400684 | | | predicted exon | 21.4 |
| 425943 | H46986 | Hs. 31861 | ESTs | 21.4 |
| 434240 | AF119912 | Hs. 258119 | hypothetical protein PRO3073 | 21.4 |
| 448376 | AI494332 | Hs. 196963 | ESTs | 21.4 |
| 408089 | H59799 | Hs. 42644 | thioredoxin-like | 21.4 |
| 400304 | AF005082 | Hs. 113261 | *Homo sapiens* skin-specific protein (xp33) mRNA, part | 21.4 |
| 412652 | AI801777 | Hs. 6774 | ESTs | 21.4 |
| 428373 | AI751656 | Hs. 183986 | poliovirus receptor-related 2 (herpesvirus entry mediato | 21.3 |
| 416138 | C18946 | Hs. 79026 | myeloid leukemia factor 2 | 21.3 |
| 425184 | BE278288 | Hs. 155048 | Lutheran blood group (Auberger b antigen included) | 21.3 |
| 411028 | AW813703 | | gb: RC3-ST0197-130100-014-h09 ST0197 Homo sapien | 21.3 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 417438 | Z43989 | Hs. 82141 | Human clone 23612 mRNA sequence | 21.3 |
| 417534 | NM_004998 | Hs. 82251 | myosin IC | 21.3 |
| 427767 | AI879283 | Hs. 180714 | cytochrome c oxidase subunit VIa polypeptide 1 | 21.2 |
| 433300 | AA582307 | | gb: nn49d09.s1 NCI_CGAP_Kid6 Homo sapiens cDNA | 21.2 |
| 452061 | AI074259 | Hs. 469 | succinate dehydrogenase complex, subunit A, flavoprot | 21.2 |
| 411939 | AI365585 | Hs. 146246 | ESTs | 21.2 |
| 435060 | AI422719 | Hs. 233349 | ESTs, Weakly similar to fork head like protein [H. sapie | 21.2 |
| 432412 | AI470549 | Hs. 162201 | ESTs | 21.2 |
| 407491 | S82769 | | gb: GABAA receptor gamma 3 subunit [human, fetal bra | 21.2 |
| 418960 | NM_004494 | Hs. 89525 | hepatoma-derived growth factor (high-mobility group p | 21.1 |
| 426254 | BE018103 | Hs. 168541 | Homo sapiens mRNA full length insert cDNA close EU | 21.1 |
| 458188 | AW297226 | Hs. 137840 | ESTs, Moderately similar to SIX1_HUMAN HOMEOB | 21.1 |
| 406215 | | | predicted exon | 21.1 |
| 425461 | AK000602 | Hs. 157938 | hypothetical protein FLJ20595 | 21.1 |
| 448296 | BE622756 | Hs. 10949 | Homo sapiens cDNA FLJ14162 fis, clone NT2RM4002 | 21.1 |
| 409415 | AA579258 | Hs. 6083 | Homo sapiens cDNA FLJ21028 fis, clone CAE07155 | 21.1 |
| 408546 | W49512 | Hs. 46348 | bradykinin receptor B1 | 21.1 |
| 450008 | H52970 | Hs. 36688 | WAP four-disulfide core domain 1 | 21.1 |
| 430998 | AF128847 | Hs. 204038 | indolethylamine N-methyltransferase | 21.1 |
| 438901 | AF085834 | Hs. 29036 | ESTs | 21.1 |
| 440500 | AA972165 | Hs. 150308 | ESTs | 21.1 |
| 413101 | BE065215 | | gb: RC1-BT0314-310300-015-f01 BT0314 Homo sapie | 21.1 |
| 447452 | BE618258 | Hs. 102480 | ESTs | 21.1 |
| 412446 | AI768015 | Hs. 92127 | ESTs | 21.1 |
| 418975 | T75496 | Hs. 296980 | ESTs | 21.0 |
| 454961 | AW847807 | | gb: IL3-CT0213-190200-040-E12 CT0213 Homo sapien | 21.0 |
| 401072 | | | predicted exon | 21.0 |
| 401204 | | | predicted exon | 21.0 |
| 433626 | AF078859 | Hs. 86347 | hypothetical protein | 21.0 |
| 418047 | R37633 | Hs. 4847 | ESTs | 21.0 |
| 443380 | AI792478 | Hs. 135377 | ESTs | 21.0 |
| 427424 | AA402453 | Hs. 113011 | ESTs | 21.0 |
| 433412 | AV653729 | Hs. 8185 | CGI-44 protein, sulfide dehydrogenase like (yeast) | 21.0 |
| 422599 | BE387202 | Hs. 118638 | non-metastatic cells 1, protein (NM23A) expressed in | 20.9 |
| 435656 | R93409 | Hs. 120759 | ESTs | 20.9 |
| 413745 | AW247252 | Hs. 75514 | nucleoside phosphorylase | 20.9 |
| 418874 | T60872 | | gb: yb72h11.s1 Stratagene ovary (937217) Homo sapien | 20.9 |
| 452574 | AF127481 | Hs. 35093 | lymphoid blast crisis oncogene | 20.9 |
| 400332 | S66407 | Hs. 248032 | FLT4 | 20.9 |
| 402421 | | | predicted exon | 20.9 |
| 427138 | N77624 | Hs. 173717 | phosphatidic acid phosphatase type 2B | 20.9 |
| 432038 | AA524746 | Hs. 162110 | ESTs | 20.8 |
| 423711 | AF059194 | Hs. 131953 | v-maf musculoaponeurotic fibrosarcoma (avian) oncoge | 20.8 |
| 402297 | | | predicted exon | 20.8 |
| 405133 | | | predicted exon | 20.8 |
| 436661 | AI125270 | Hs. 128069 | ESTs, Weakly similar to similar to collagen [C. elegans] | 20.8 |
| 437836 | BE269291 | Hs. 292458 | ESTs | 20.8 |
| 437329 | AA811977 | Hs. 291761 | ESTs | 20.8 |
| 445830 | H10451 | Hs. 42656 | Homo sapiens cDNA FLJ12667 fis, clone NT2RM4002 | 20.8 |
| 406824 | AW515961 | Hs. 84298 | CD74 antigen (invariant polypeptide of major histocom | 20.7 |
| 421271 | AW170057 | Hs. 133179 | ESTs | 20.7 |
| 400256 | | | predicted exon | 20.7 |
| 414028 | AA782576 | Hs. 4944 | Homo sapiens cDNA FLJ12783 fis, clone NT2RP2001 | 20.7 |
| 456728 | AL120077 | Hs. 122967 | kelch (Drosophila)-like 2 (Mayven) | 20.7 |
| 417707 | AL035786 | Hs. 82425 | actin related protein 2/3 complex, subunit 5(16 kD) | 20.7 |
| 438713 | H16902 | Hs. 6749 | ESTs | 20.7 |
| 450306 | AL080080 | Hs. 24766 | DKFZP564E1962 protein | 20.7 |
| 438898 | AI819863 | Hs. 106243 | ESTs | 20.7 |
| 403273 | | | predicted exon | 20.7 |
| 414605 | BE390440 | | gb: 601283601F1 NIH_MGC_44 Homo sapiens cDNA | 20.7 |
| 401283 | | | predicted exon | 20.7 |
| 403703 | | | predicted exon | 20.6 |
| 416969 | AI815443 | Hs. 283404 | organic cation transporter | 20.6 |
| 442400 | AW381148 | Hs. 3593 | ESTs | 20.6 |
| 447563 | BE536115 | Hs. 160983 | ESTs | 20.5 |
| 419754 | H52299 | Hs. 75243 | bromodomain-centaining 2 | 20.5 |
| 408204 | AA454501 | Hs. 43666 | protein tyrosine phosphatase type IVA, member 3 | 20.5 |
| 450507 | AW295603 | Hs. 250891 | ESTs | 20.5 |
| 429612 | AF062649 | Hs. 252587 | pituitary tumor-transforming 1 | 20.5 |
| 413758 | BE162391 | | gb: PM2-HT0451-090100-002-f04 HT0451 Homo sapie | 20.5 |
| 432140 | AK000404 | Hs. 272688 | hypothetical protein FLJ20397 | 20.5 |
| 400642 | | | predicted exon | 20.4 |
| 431582 | F07136 | Hs. 261828 | G protein-coupled receptor kinase 7 | 20.4 |
| 442724 | AA355525 | Hs. 159604 | cysteinyl-tRNA synthetase | 20.4 |
| 417861 | AA334551 | Hs. 82767 | sperm specific antigen 2 | 20.4 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 402948 | | | predicted exon | 20.4 |
| 411004 | AW813242 | | gb: MR3-ST0191-020200-207-g10 ST0191 Homo sapie | 20.4 |
| 435478 | AA682622 | | gb: zj20f09.s1 Soares_fetal_liver_spleen_1NFLS_S1 Ho | 20.4 |
| 447955 | BE544271 | Hs. 288390 | *Homo sapiens* cDNA FLJ22795 fis, clone KAIA2543 | 20.3 |
| 433592 | NM_004642 | Hs. 3436 | deleted in oral cancer (mouse, homolog) 1 | 20.3 |
| 420865 | N73241 | Hs. 100001 | solute carrier family 17 (sodium phosphate), member 1 | 20.3 |
| 449482 | AI784266 | Hs. 28774 | ESTs | 20.3 |
| 400807 | | | predicted exon | 20.3 |
| 419942 | U25138 | Hs. 93841 | potassium large conductance calcium-activated channel | 20.3 |
| 420783 | AI659838 | Hs. 99923 | lectin, galactoside-binding, soluble, 7 (galectin 7) | 20.3 |
| 402986 | BE244588 | Hs. 6456 | chaperonin containing TCP1, subunit 2 (beta) | 20.3 |
| 451375 | AI792066 | Hs. 283902 | *Homo sapiens* BAC clone RP11-481J13 from 2 | 20.3 |
| 453586 | AA248089 | Hs. 50841 | ESTs, Weakly similar to tuftelin [*M. musculus*] | 20.3 |
| 433090 | AI720050 | Hs. 145362 | immortalization-upregulated protein | 20.3 |
| 425053 | AF046024 | Hs. 154320 | ubiquitin-activating enzyme E1C (homologous to yeast | 20.3 |
| 412802 | U41518 | Hs. 74602 | aquaporin 1 (channel-forming integral protein, 28 kD) | 20.3 |
| 409738 | BE222975 | Hs. 56205 | insulin induced gene 1 | 20.3 |
| 428245 | AF151048 | Hs. 183180 | hypothetical protein | 20.2 |
| 412582 | BE270631 | Hs. 74077 | proteasome (prosome, macropain) subunit, alpha type, 6 | 20.2 |
| 406207 | | | predicted exon | 20.2 |
| 400931 | | | predicted exon | 20.2 |
| 410709 | AL122109 | Hs. 65735 | *Homo sapiens* mRNA; cDNA DKFZp434M1827 (from | 20.2 |
| 428438 | NM_001955 | Hs. 2271 | endothelin 1 | 20.2 |
| 446918 | AL135125 | Hs. 13913 | KIAA1577 protein | 20.2 |
| 417821 | BE245149 | Hs. 82643 | protein tyrosine kinase 9 | 20.2 |
| 429113 | D28235 | Hs. 196384 | prostaglandin-endoperoxide synthase 2 (prostaglandin G | 20.2 |
| 414511 | AA148725 | Hs. 12969 | hypothetical protein | 20.2 |
| 451546 | AF051782 | Hs. 26584 | *Homo sapiens* clone CDABP0038 mRNA sequence | 20.1 |
| 441899 | AI372588 | Hs. 8022 | TU3A protein | 20.1 |
| 425811 | AL039104 | Hs. 159557 | karyopherin alpha 2 (RAG cohort 1, importin alpha 1) | 20.1 |
| 411014 | AW816072 | | gb: MR3-ST0220-070100-021-h07 ST0220 Homo sapie | 20.1 |
| 451400 | BE160479 | | gb: QV1-HT0413-210200-081-g05 HT0413 Homo sapi | 20.1 |
| 459247 | N46243 | Hs. 110373 | ESTs | 20.1 |
| 441633 | AW958544 | Hs. 112242 | ESTs | 20.1 |
| 427466 | AA523543 | Hs. 7678 | cellular retinoic acid-binding protein 1 | 20.0 |
| 406893 | M22406 | | gb: Human intestinal mucin mRNA, partial cds, clone SM | 20.0 |
| 406268 | | | predicted exon | 20.0 |
| 403348 | | | predicted exon | 20.0 |
| 400970 | | | predicted exon | 20.0 |
| 414045 | NM_002951 | Hs. 75722 | ribophorin II | 20.0 |
| 427169 | AA398823 | Hs. 97549 | EST | 20.0 |
| 405586 | | | predicted exon | 20.0 |
| 445834 | AI913290 | Hs. 145532 | ESTs, Weakly similar to Gag polyprotein [*M. musculus* | 20.0 |
| 422525 | AA758797 | Hs. 192807 | ESTs | 20.0 |
| 425383 | D83407 | Hs. 156007 | Down syndrome critical region gene 1-like 1 | 20.0 |
| 454590 | AW809762 | Hs. 222056 | *Homo sapiens* cDNA FLJ11572 fis, clone HEMBA100 | 20.0 |
| 411529 | AA430348 | Hs. 288837 | *Homo sapiens* cDNA FLJ12927 fis, clone NT2RP2004 | 20.0 |
| 425397 | J04088 | Hs. 156346 | topoisomerase (DNA) II alpha (170 kD) | 20.0 |
| 403234 | | | predicted exon | 19.9 |
| 427267 | AI201185 | Hs. 119164 | ESTs | 19.9 |
| 400203 | | | predicted exon | 19.9 |
| 449296 | AL137257 | Hs. 23458 | *Homo sapiens* mRNA, cDNA DKFZp434C1613 (from | 19.9 |
| 406704 | M21665 | Hs. 929 | myosin, heavy polypeptide 7, cardiac muscle, beta | 19.9 |
| 423083 | AA321774 | Hs. 10941 | ESTs, Weakly similar to IPP1_HUMAN PROTEIN PH | 19.9 |
| 422112 | BE540240 | Hs. 111783 | Lsm1 protein | 19.9 |
| 413282 | BE078159 | | gb: CM0-BT0615-140200-175-e06 BT0615 Homo sapie | 19.9 |
| 453702 | AA037637 | Hs. 42128 | ESTs | 19.9 |
| 403065 | | | predicted exon | 19.9 |
| 440633 | AI140686 | Hs. 263320 | ESTs | 19.9 |
| 456994 | AA383623 | Hs. 293616 | ESTs | 19.9 |
| 458260 | R41782 | Hs. 22279 | ESTs | 19.9 |
| 452388 | BE019696 | Hs. 29287 | retinoblastoma-binding protein 8 | 19.9 |
| 422278 | AF072873 | Hs. 114218 | frizzled (Drosophila) homolog 6 | 19.9 |
| 441989 | AA306207 | Hs. 286241 | *Homo sapiens* cDNA FLJ22698 fis, clone HSI12044 | 19.9 |
| 418758 | AW959311 | Hs. 87019 | ESTs | 19.9 |
| 406646 | M33600 | Hs. 180255 | major histocompatibility complex, class II, DR beta 1 | 19.8 |
| 433053 | BE301909 | Hs. 279952 | glutathione S-transferase subunit 13 homolog | 19.8 |
| 414194 | BE175494 | Hs. 75811 | N-acylsphingosine amidohydrolase (acid ceramidase) | 19.8 |
| 452321 | AW844498 | Hs. 289052 | *Homo sapiens* LENG8 mRNA, variant C, partial sequen | 19.8 |
| 449713 | AW027025 | Hs. 239262 | ESTs | 19.8 |
| 458827 | AW970786 | Hs. 178470 | *Homo sapiens* cDNA FLJ22662 fis, clone HSI08080 | 19.8 |
| 414092 | Z14244 | Hs. 75752 | cytochrome c oxidase subunit VIIb | 19.8 |
| 441730 | AI243276 | Hs. 149017 | ESTs | 19.8 |
| 420701 | N42919 | Hs. 88630 | ESTs, Weakly similar to AC007228 1 R31665 2 [H. sap | 19.8 |
| 403642 | | | predicted exon | 19.8 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 408987 | H85615 | | gb: yt03f11.r1 Soares retina N2b5HR Homo sapiens cD | 19.8 |
| 446712 | AW204789 | Hs. 209828 | ESTs | 19.8 |
| 403286 | | | predicted exon | 19.8 |
| 434439 | AI022360 | Hs. 190583 | ESTs | 19.8 |
| 404067 | | | predicted exon | 19.7 |
| 455694 | BE067300 | | gb: PM2-BT0349-161299-001-h10 BT0349 Homo sapie | 19.7 |
| 403287 | | | predicted exon | 19.7 |
| 434633 | AI189587 | Hs. 120915 | ESTs | 19.7 |
| 408199 | AA132637 | Hs. 15396 | ESTs | 19.7 |
| 420080 | M94065 | Hs. 94925 | dihydroorotate dehydrogenase | 19.7 |
| 408852 | AW291435 | Hs. 254961 | ESTs | 19.7 |
| 403786 | | | predicted exon | 19.7 |
| 416839 | H94900 | Hs. 17882 | ESTs | 19.7 |
| 434385 | AA631946 | Hs. 259580 | ESTs | 19.7 |
| 446845 | AI343645 | Hs. 156108 | ESTs | 19.7 |
| 425612 | BE004257 | | gb: CM0-BN0103-180300-296-c04 BN0103 Homo sapi | 19.7 |
| 402520 | | | predicted exon | 19.6 |
| 436098 | R20597 | Hs. 9739 | ESTs | 19.6 |
| 438974 | AF089816 | Hs. 6454 | chromosome 19 open reading frame 3 | 19.6 |
| 447751 | AA339541 | Hs. 24956 | hypothetical protein FLJ22056 | 19.6 |
| 451310 | AW250651 | Hs. 26213 | ESTs, Moderately similar to dJ447F3 3 [*H. sapiens*] | 19.6 |
| 435961 | BE293127 | Hs. 283722 | GTT1 protein | 19.6 |
| 452937 | BE410390 | Hs. 288940 | five-span transmembrane protein M83 | 19.6 |
| 404850 | | | predicted exon | 19.6 |
| 438360 | H74149 | Hs. 288193 | hypothetical protein FLJ10375 | 19.6 |
| 436508 | AW604381 | Hs. 121121 | ESTs | 19.6 |
| 430486 | BE062109 | Hs. 241551 | chloride channel, calcium activated, family member 2 | 19.6 |
| 407824 | AA147884 | Hs. 9812 | ESTs | 19.6 |
| 406388 | | | predicted exon | 19.6 |
| 430204 | AA618335 | Hs. 146137 | ESTs, Weakly similar to putative [*C. elegans*] | 19.5 |
| 457560 | AI801934 | Hs. 163909 | ESTs | 19.5 |
| 429521 | BE048708 | Hs. 50949 | ESTs | 19.5 |
| 429758 | AW137722 | Hs. 246804 | ESTs | 19.5 |
| 441473 | AA934995 | Hs. 184846 | ESTs, Weakly similar to R28830 1 [*H. sapiens*] | 19.5 |
| 411724 | AA770559 | Hs. 71618 | polymerase (RNA) II (DNA directed) polypeptide L (7 | 19.5 |
| 450453 | AA009883 | Hs. 50186 | ESTs | 19.5 |
| 419687 | AI638859 | Hs. 227699 | ESTs, Weakly similar to Yhr217cp [*S. cerevisiae*] | 19.5 |
| 442162 | AW294966 | Hs. 150849 | ESTs | 19.5 |
| 435056 | AW023337 | Hs. 5422 | glycoprotein M6B | 19.5 |
| 417412 | X16896 | Hs. 82112 | interleukin 1 receptor, type I | 19.5 |
| 413825 | BE299181 | Hs. 75564 | CD151 antigen | 19.4 |
| 422687 | AW068823 | Hs. 119206 | insulin-like growth factor binding protein 7 | 19.4 |
| 435551 | AF212365 | Hs. 5470 | IL-17B receptor | 19.4 |
| 440069 | BE617892 | Hs. 6895 | actin related protein 2/3 complex, subunit 3 (21 kD) | 19.4 |
| 432277 | AI669790 | Hs. 161825 | ESTs | 19.4 |
| 428044 | AA093322 | Hs. 182225 | RNA binding motif protein 3 | 19.4 |
| 456064 | AA256213 | Hs. 72010 | ESTs | 19.4 |
| 424897 | D63216 | Hs. 153684 | frizzled-related protein | 19.4 |
| 424673 | AA345051 | Hs. 294092 | ESTs | 19.4 |
| 403852 | | | predicted exon | 19.3 |
| 405699 | | | predicted exon | 19.3 |
| 433096 | AU076803 | Hs. 282975 | carboxylesterase 2 (intestine, liver) | 19.3 |
| 400344 | NM_012368 | Hs. 258574 | olfactory receptor, family 2, subfamily C, member 1 | 19.3 |
| 417501 | AL041219 | Hs. 82222 | sema domain, immunoglobulin domain (Ig), short basic | 19.3 |
| 400449 | | | predicted exon | 19.3 |
| 453801 | AL134751 | Hs. 23450 | mRNA for FLJ00023 protein | 19.3 |
| 435849 | BE305242 | Hs. 112442 | ESTs, Weakly similar to CLDE_HUMAN CLAUDIN- | 19.3 |
| 454181 | AW177377 | | gb: CM4-CT0129-190899-007-e09 CT0129 Homo sapie | 19.3 |
| 414807 | AI738616 | Hs. 77348 | hydroxyprostaglandin dehydrogenase 15-(NAD) | 19.3 |
| 406326 | | | predicted exon | 19.3 |
| 421921 | H83363 | Hs. 109571 | translocase of inner mitochondrial membrane 10 (yeast) | 19.3 |
| 416700 | AW498958 | Hs. 79572 | cathepsin D (lysosomal aspartyl protease) | 19.2 |
| 458857 | AI627342 | Hs. 224801 | ESTs | 19.2 |
| 405501 | | | predicted exon | 19.2 |
| 416601 | R08652 | Hs. 20205 | hemoglobin, beta pseudogene 1 | 19.2 |
| 426600 | NM_003378 | Hs. 171014 | VGF nerve growth factor inducible | 19.2 |
| 425590 | AI954686 | Hs. 158321 | beaded filament structural protein 2, phakinin | 19.2 |
| 428151 | AA422028 | | gb: zv26g06 r1 Soares_NhHMPu_S1 Homo sapiens cDN | 19.2 |
| 426420 | BE383808 | Hs. 169829 | KIAA1180 protein | 19.2 |
| 414428 | BE296906 | Hs. 182625 | VAMP (vesicle-associated membrane protein)-associate | 19.2 |
| 404601 | | | predicted exon | 19.2 |
| 403861 | | | predicted exon | 19.2 |
| 448363 | BE174595 | Hs. 366 | 6-pyruvoyltetrahydroptenn synthase | 19.2 |
| 406655 | M21533 | Hs. 181244 | major histocompatibility complex, class I, A | 19.1 |
| 435372 | AA809591 | Hs. 106486 | ESTs, Highly similar to CIKG_HUMAN VOLTAGE-G | 19.1 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 413154 | BE067870 | | gb: RC0-BT0362-021299-031-b06 BT0362 Homo sapie | 19.1 |
| 443021 | AA368546 | Hs. 8904 | Ig superfamily protein | 19.1 |
| 412975 | T70956 | Hs. 75106 | clusterin (complement lysis inhibitor, SP-40,40, sulfated | 19.1 |
| 412633 | AF001691 | Hs. 74304 | periplakin | 19.1 |
| 402071 | | | predicted exon | 19.1 |
| 410387 | AI277367 | Hs. 47094 | ESTs | 19.1 |
| 423961 | D13666 | Hs. 136348 | osteoblast specific factor 2 (fasciclin I-like) | 19.1 |
| 407032 | U73799 | | gb: Human dynactin mRNA, partial cds. | 19.0 |
| 404034 | | | predicted exon | 19.0 |
| 456534 | X91195 | Hs. 100623 | phospholipase C, beta 3, neighbor pseudogene | 19.0 |
| 446599 | Z97832 | Hs. 15476 | differentially expressed in FDCP (mouse homolog) 6 | 19.0 |
| 426410 | BE298446 | Hs. 180372 | BCL2-like 1 | 19.0 |
| 419618 | AA528295 | | gb: nh26e06 s1 NCI_CGAP_Pr3 Homo sapiens cDNA c | 19.0 |
| 457632 | AW292151 | Hs. 112689 | ESTs | 19.0 |
| 417138 | AA193646 | Hs. 65771 | Homo sapiens chromosome 19, BAC CIT-HSPC_204F | 19.0 |
| 417933 | X02308 | Hs. 82962 | thymidylate synthetase | 19.0 |
| 458808 | AW134832 | Hs. 246295 | ESTs | 19.0 |
| 415860 | D56051 | Hs. 78888 | diazepam binding inhibitor (GABA receptor modulator | 18.9 |
| 440919 | AW291274 | Hs. 262826 | ESTs | 18.9 |
| 423725 | AJ403108 | Hs. 132127 | hypothetical protein LOC57822 | 18.9 |
| 401747 | | | predicted exon | 18.9 |
| 454209 | AW179083 | | gb: MR4-ST0065-270899-006-A07 ST0065 Homo sapi | 18.8 |
| 417661 | T84155 | Hs. 15464 | Homo sapiens cDNA: FLJ21351 fis, clone COL02762 | 18.8 |
| 426499 | C14937 | Hs. 11169 | Gene 33/Mig-6 | 18.8 |
| 404240 | | | predicted exon | 18.8 |
| 439718 | AA307634 | Hs. 6650 | vacuolar protein sorting 45B (yeast homolog) | 18.8 |
| 401789 | | | predicted exon | 18.8 |
| 456952 | AW445081 | Hs. 301469 | ESTs | 18.8 |
| 439739 | AI199391 | Hs. 124464 | ESTs | 18.8 |
| 437974 | T74445 | Hs. 5957 | Homo sapiens clone 24416 mRNA sequence | 18.8 |
| 427490 | Z95152 | Hs. 178695 | mitogen-activated protein kinase 13 | 18.8 |
| 443482 | AW188093 | Hs. 250385 | ESTs | 18.8 |
| 411420 | BE390652 | | gb: 601286820F1 NIH_MGC_44 Homo sapiens cDNA | 18.8 |
| 435196 | F35675 | Hs. 188128 | ESTs, Moderately similar to ALUB_HUMAN !!!! ALU | 18.8 |
| 417022 | NM_014737 | Hs. 80905 | Ras association (RalGDS/AF-6) domain family 2 | 18.8 |
| 413531 | AL036958 | Hs. 75416 | DAZ associated protein 2 | 18.7 |
| 428981 | BE313077 | Hs. 93135 | ESTs | 18.7 |
| 421598 | AW630942 | Hs. 106061 | RD RNA-binding protein | 18.7 |
| 443907 | AU076484 | Hs. 9963 | TYRO protein tyrosine kinase binding protein | 18.7 |
| 406754 | AA477223 | Hs. 75922 | brain protein 13 | 18.7 |
| 400661 | | | predicted exon | 18.7 |
| 442638 | AI088742 | Hs. 134713 | ESTs | 18.7 |
| 434169 | AA883752 | Hs. 179724 | ESTs | 18.7 |
| 424126 | AA335635 | Hs. 96917 | ESTs | 18.7 |
| 408473 | BE259039 | Hs. 129953 | Ewing sarcoma breakpoint region 1 | 18.7 |
| 401962 | | | predicted exon | 18.7 |
| 447326 | AW002252 | Hs. 201395 | ESTs | 18.7 |
| 459053 | AI807052 | Hs. 210361 | ESTs | 18.7 |
| 403362 | | | predicted exon | 18.7 |
| 427697 | T18997 | Hs. 180372 | BCL2-like 1 | 18.7 |
| 402061 | H83363 | Hs. 109571 | translocase of inner mitochondrial membrane 10 (yeast) | 18.7 |
| 433785 | BE044593 | Hs. 112704 | ESTs | 18.7 |
| 405423 | | | predicted exon | 18.6 |
| 429259 | AA420450 | Hs. 292911 | ESTs | 18.6 |
| 444071 | AI627808 | Hs. 110524 | ESTs | 18.6 |
| 410512 | AA085603 | Hs. 250570 | ESTs | 18.6 |
| 440376 | AI024452 | Hs. 236816 | ESTs | 18.6 |
| 457353 | X65633 | Hs. 248144 | melanocortin 2 receptor (adrenocorticotropic hormone) | 18.6 |
| 432749 | NM_014438 | Hs. 278909 | Interleukin-1 Superfamily e | 18.6 |
| 415602 | F12920 | Hs. 165575 | ESTs | 18.6 |
| 407891 | AA486620 | Hs. 41135 | endomucin-2 | 18.6 |
| 455910 | Z43712 | | gb: HSC1JA121 normalized infant brain cDNA Homo s | 18.6 |
| 426716 | NM_006379 | Hs. 171921 | sema domain, immunoglobulin domain (Ig), short basic | 18.6 |
| 444246 | H93281 | Hs. 10710 | hypothetical protein FLJ20417 | 18.6 |
| 428125 | AA393071 | Hs. 182579 | leucine aminopeptidase | 18.6 |
| 406457 | | | predicted exon | 18.5 |
| 446625 | AI333070 | Hs. 156141 | ESTs | 18.5 |
| 423334 | AK000906 | Hs. 127273 | hypothetical protein FLJ10044 | 18.5 |
| 423103 | AA322029 | | gb: EST24685 Cerebellum II Homo sapiens cDNA 5' en | 18.5 |
| 443549 | T89608 | Hs. 16601 | ESTs | 18.5 |
| 419299 | AI311085 | Hs. 62406 | Homo sapiens cDNA: FLJ22573 fis, clone HSI02387 | 18.5 |
| 411942 | AW877015 | | gb: QV2-PT0010-250300-096-f12 PT0010 Homo sapien | 18.5 |
| 442440 | BE464435 | Hs. 146180 | ESTs, Weakly similar to non-receptor protein tyrosine k | 18.5 |
| 454574 | AW809109 | | gb: MR4-ST0117-070100-027-a04 ST0117 Homo sapie | 18.5 |
| 454377 | AA076811 | | gb: 7B03C12 Chromosome 7 Fetal Brain cDNA Library | 18.5 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 422365 | AF035537 | Hs. 115521 | REV3 (yeast homotog)-like, catalytic subunit of DNA p | 18.5 |
| 421733 | AL119671 | Hs. 1420 | fibroblast growth factor receptor 3 (achondroplasia, tha | 18.5 |
| 420603 | AB042636 | Hs. 4775 | junctophilin 3 | 18.4 |
| 401373 | | | predicted exon | 18.4 |
| 402292 | | | predicted exon | 18.4 |
| 444118 | AA458542 | Hs. 10326 | coatomer protein complex, subunit epsilon | 18.4 |
| 408310 | AW179023 | | gb: PM3-ST0036-170899-001-e08 ST0036 Homo sapie | 18.4 |
| 411236 | AW833752 | | gb: QV4-TT0008-130100-077-b07 TT0008 Homo sapie | 18.4 |
| 431405 | AI470895 | Hs. 252574 | ribosomal protein L10a | 18.4 |
| 441408 | AI733249 | Hs. 126897 | ESTs | 18.4 |
| 453994 | BE180964 | Hs. 165590 | ribosomal protein S13 | 18.4 |
| 444518 | AI160278 | Hs. 146884 | ESTs | 18.4 |
| 402407 | | | predicted exon | 18.4 |
| 404270 | | | predicted exon | 18.4 |
| 409103 | AF251237 | Hs. 112208 | XAGE-1 protein | 18.4 |
| 415198 | AW009480 | Hs. 943 | natural killer cell transcript 4 | 18.3 |
| 430771 | BE387244 | Hs. 2664 | flavin containing monooxygenase 4 | 18.3 |
| 432636 | AA340864 | Hs. 278562 | claudin 7 | 18.3 |
| 433504 | NM_014874 | Hs. 3363 | KIAA0214 gene product | 18.3 |
| 415606 | W70022 | | gb: zd51e10.r1 Soares_fetal_heart_NbHH19W Homo sa | 18.3 |
| 401401 | BE047878 | Hs. 99093 | Homo sapiens chromosome 19, cosmid R28379 | 18.3 |
| 420758 | AW297536 | Hs. 33053 | ESTs | 18.3 |
| 457520 | AA553495 | Hs. 162264 | ESTs | 18.3 |
| 432323 | AK001409 | Hs. 274356 | hypothetical protein FLJ10547 | 18.3 |
| 404750 | | | predicted exon | 18.3 |
| 450645 | AL117441 | Hs. 25264 | DKFZP434N126 protein | 18.3 |
| 445160 | AI299144 | Hs. 150797 | ESTs | 18.3 |
| 418461 | BE242781 | Hs. 288037 | Homo sapiens cDNA FLJ12999 fis, clone NT2RP3000 | 18.3 |
| 401809 | | | predicted exon | 18.3 |
| 458121 | S42416 | Hs. 74647 | Human T-cell receptor active alpha-chain mRNA from | 18.3 |
| 435106 | AA100847 | Hs. 193380 | ESTs, Highly similar to AF174600 1 F-box protein Fbx | 18.3 |
| 448398 | AW444655 | Hs. 170838 | ESTs | 18.3 |
| 428145 | BE243327 | Hs. 182626 | chromosome 22 open reading frame 5 | 18.2 |
| 445302 | AK001537 | Hs. 12488 | hypothetical protein FLJ10675 | 18.2 |
| 407352 | H47860 | | gb: yp76h12 r1 Soares fetal liver spleen 1NFLS Homo s | 18.2 |
| 413190 | AA151802 | Hs. 40368 | adaptor-related protein complex 1, sigma 2 subunit | 18.2 |
| 436371 | AI821912 | Hs. 113912 | ESTs | 18.2 |
| 400965 | | | predicted exon | 18.2 |
| 433427 | AI816449 | Hs. 171889 | cholinephosphotransferase 1 | 18.2 |
| 427504 | AA776743 | Hs. 191589 | ESTs | 18.2 |
| 426759 | AI590401 | Hs. 21213 | ESTs | 18.2 |
| 423792 | AW135866 | Hs. 245854 | ESTs | 18.2 |
| 406826 | AW516005 | Hs. 84298 | CD74 antigen (invariant polypeptide of major histocom | 18.1 |
| 406659 | AA663985 | Hs. 277477 | major histocompatibility complex, class I, C | 18.1 |
| 437453 | AI761350 | Hs. 181391 | hypothetical protein DKFZp761G2113 | 18.1 |
| 409276 | AW372097 | Hs. 278429 | hepatocellular carcinoma-associated antigen 59 | 18.1 |
| 449628 | AI697676 | Hs. 197713 | ESTs | 18.1 |
| 421043 | BE379455 | Hs. 89072 | ESTs | 18.1 |
| 442344 | AI022925 | Hs. 301212 | ESTs | 18.1 |
| 448744 | AL135424 | Hs. 9469 | phosphoinositol 3-phosphate binding protein-1 | 18.1 |
| 416062 | AA724811 | Hs. 74427 | p53-induced protein | 18.1 |
| 414500 | W24087 | Hs. 76285 | DKFZP564B167 protein | 18.1 |
| 427272 | NM_001096 | Hs. 174140 | ATP citrate lyase | 18.1 |
| 403964 | | | predicted exon | 18.1 |
| 433217 | AB040914 | Hs. 278628 | KIAA1481 protein | 18.1 |
| 427902 | AI809202 | Hs. 208343 | ESTs, Weakly similar to cerebroside sulfotransferase [H. | 18.1 |
| 449586 | AI863918 | Hs. 195078 | ESTs | 18.1 |
| 430826 | U10061 | Hs. 248019 | POU domain, class 4, transcription factor 3 | 18.1 |
| 414195 | BE263293 | | gb: 601144881F2 NIH_MGC_19 Homo sapiens cDNA | 18.1 |
| 416305 | AU076628 | Hs. 79187 | coxsackie virus and adenovirus receptor | 18.1 |
| 411088 | BE247593 | Hs. 145053 | ESTs | 18.1 |
| 419407 | AW410377 | Hs. 41502 | Homo sapiens cDNA FLJ21276 fis, clone COL01829 | 18.1 |
| 407938 | AA905097 | Hs. 85050 | phospholamban | 18.1 |
| 449360 | AI640623 | Hs. 252720 | ESTs | 18.1 |
| 417286 | AA122237 | Hs. 81874 | microsomal glutathione S-transferase 2 | 18.0 |
| 405515 | | | predicted exon | 18.0 |
| 439319 | AW016401 | Hs. 233476 | ESTs | 18.0 |
| 419387 | BE379356 | Hs. 90107 | cell membrane glycoprotein, 110000M(r) (surface antig | 18.0 |
| 414015 | AA340987 | Hs. 75693 | prolylcarboxypeptidase (angiotensinase C) | 18.0 |
| 447778 | BE620592 | Hs. 71190 | ESTs | 18.0 |
| 435523 | T62849 | Hs. 11090 | high affinity immunoglobulin epsilon receptor beta sub | 18.0 |
| 429230 | AF088991 | Hs. 198274 | NADH dehydrogenase (ubiquinone) 1 beta subcomplex | 18.0 |
| 457822 | AA970001 | Hs. 150319 | ESTs | 18.0 |
| 442424 | AI342715 | Hs. 129569 | ESTs, Moderately similar to B34087 hypothetical prote | 18.0 |
| 418394 | AF132818 | Hs. 84728 | Kruppel-like factor 5 (intestinal) | 18.0 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 413477 | AI815825 | Hs. 48756 | ESTs, Moderately similar to neuronal-STOP protein [M | 18.0 |
| 405277 | | | predicted exon | 18.0 |
| 450192 | AA263143 | Hs. 24596 | RAD51-interacting protein | 18.0 |
| 442191 | W95186 | Hs. 8136 | endothelial PAS domain protein 1 | 18.0 |
| 429490 | AI971131 | Hs. 293684 | ESTs, Weakly similar to alternatively spliced product u | 18.0 |
| 406744 | AA554082 | Hs. 279860 | hypothetical protein FLJ20030 | 17.9 |
| 425205 | NM_005854 | Hs. 155106 | receptor (calcitonin) activity modifying protein 2 | 17.9 |
| 414387 | AL043148 | Hs. 186257 | ESTs | 17.9 |
| 411811 | AW864370 | | gb: PM4-SN0016-100500-004-h09 SN0016 Homo sapie | 17.9 |
| 433882 | U90441 | Hs. 3622 | procollagen-proline, 2-oxoglutarate 4-dioxygenase (pro | 17.9 |
| 414333 | BE274897 | | gb: 601122959F1 NIH_MGC_20 Homo sapiens cDNA | 17.9 |
| 403747 | | | predicted exon | 17.9 |
| 435542 | AA687376 | Hs. 269533 | ESTs | 17.9 |
| 403093 | | | predicted exon | 17.9 |
| 412088 | AI689496 | Hs. 108932 | ESTs | 17.9 |
| 450506 | NM_004460 | Hs. 418 | fibroblast activation protein, alpha | 17.9 |
| 404763 | | | predicted exon | 17.9 |
| 454633 | AW811380 | | gb: IL3-ST0143-260999-019-D05 ST0143 Homo sapien | 17.9 |
| 440788 | AI806594 | Hs. 128577 | ESTs | 17.9 |
| 411800 | N39342 | Hs. 5184 | TH1 drosophila homolog | 17.9 |
| 441361 | BE263308 | Hs. 7797 | TERF1 (TRF1)-interacting nuclear factor 2 | 17.8 |
| 422033 | AW245805 | Hs. 110903 | claudin 5 (transmembrane protein deleted in velocardiof | 17.8 |
| 405333 | | | predicted exon | 17.8 |
| 408297 | R17710 | Hs. 113314 | ESTs | 17.8 |
| 403036 | | | predicted exon | 17.8 |
| 417924 | AU077231 | Hs. 82932 | cyclin D1 (PRAD1: parathyroid adenomatosis 1) | 17.8 |
| 417091 | AA193283 | Hs. 291990 | ESTs | 17.8 |
| 440789 | AB007857 | Hs. 7416 | KIAA0397 gene product | 17.8 |
| 438397 | AA806478 | Hs. 123206 | ESTs | 17.8 |
| 435948 | AA702675 | Hs. 114135 | ESTs | 17.8 |
| 450273 | AW296454 | Hs. 24743 | hypothetical protein FLJ20171 | 17.8 |
| 435969 | W85773 | Hs. 191386 | ESTs | 17.8 |
| 427031 | AA397601 | Hs. 125147 | ESTs | 17.8 |
| 454505 | AW801365 | | gb: IL5-UM0067-240300-050-a01 UM0067 Homo sapi | 17.8 |
| 403447 | | | predicted exon | 17.8 |
| 433297 | AV658581 | Hs. 282633 | ESTs | 17.8 |
| 443326 | BE156494 | Hs. 188478 | ESTs | 17.8 |
| 448283 | AI340462 | Hs. 182979 | ribosomal protein L12 | 17.8 |
| 458067 | AA393603 | Hs. 36752 | Homo sapiens cDNA: FLJ22834 fis, clone KAIA4314 | 17.8 |
| 452359 | BE167229 | Hs. 29206 | Homo sapiens close 24659 mRNA sequence | 17.8 |
| 434098 | AA625499 | | gb: af69g08.r1 Soares_NhHMPu_S1 Homo sapiens cDN | 17.8 |
| 450911 | AA011586 | Hs. 272097 | ESTs | 17.7 |
| 410342 | R31350 | Hs. 743 | Fc fragment of IgE, high affinity I, receptor for, gamma | 17.7 |
| 407082 | Z47055 | | gb: Human partial cDNA sequence, farnesyl pyrophosph | 17.7 |
| 415271 | X94232 | Hs. 78335 | microtubule-associated protein, RP/EB family, member | 17.7 |
| 417413 | AA197072 | Hs. 86092 | Human DNA sequence from clone RP11-243J16 on chr | 17.7 |
| 408937 | AA210734 | Hs. 291386 | ESTs | 17.7 |
| 433459 | AA593498 | | gb: nn27b05.s1 NCI_CGAP_Gas1 Homo sapiens cDNA | 17.7 |
| 459536 | AI254723 | Hs. 145496 | ESTs | 17.7 |
| 428500 | AI815395 | Hs. 184641 | delta-6 fatty acid desaturase | 17.7 |
| 433463 | R41963 | Hs. 4197 | ESTs | 17.7 |
| 406537 | | | predicted exon | 17.7 |
| 410003 | AA079487 | | gb: zm97f08 s1 Stratagene colon HT29 (937221) Homo | 17.7 |
| 440857 | AA907808 | Hs. 135556 | ESTs | 17.7 |
| 451072 | AA013451 | Hs. 117929 | ESTs | 17.7 |
| 418693 | AI750878 | Hs. 87409 | thrombospondin 1 | 17.7 |
| 443624 | BE616129 | Hs. 9651 | related RAS viral (r-ras) oncogene homolog | 17.6 |
| 422626 | AA344932 | Hs. 118786 | metallothionein 2A | 17.6 |
| 410756 | AB037820 | Hs. 66159 | KIAA1399 protein | 17.6 |
| 436621 | AI266254 | Hs. 132929 | ESTs | 17.6 |
| 453317 | NM_002277 | Hs. 41696 | keratin, hair, acidic, 1 | 17.6 |
| 456828 | AF156889 | Hs. 148427 | LIM homeobox protein 3 | 17.6 |
| 421486 | AW408800 | Hs. 104859 | hypothetical protein DKFZp762E1312 | 17.6 |
| 428834 | AW899713 | Hs. 10338 | ESTs | 17.6 |
| 451419 | R36309 | Hs. 174369 | EST | 17.6 |
| 448413 | AI745379 | Hs. 42911 | ESTs | 17.6 |
| 424323 | AA338791 | Hs. 146763 | nascent-polypeptide-associated complex alpha polypept | 17.6 |
| 423943 | AF163570 | Hs. 135756 | polymerase (DNA-directed) kappa | 17.6 |
| 439423 | BE536678 | Hs. 147099 | ESTs | 17.6 |
| 434025 | AF114264 | Hs. 216381 | Homo sapiens clone HH409 unknown mRNA | 17.6 |
| 408246 | N55669 | Hs. 43946 | L13 protein | 17.6 |
| 441579 | AW468847 | Hs. 127194 | ESTs | 17.5 |
| 420867 | NM_014183 | Hs. 100002 | HSPC162 protein | 17.5 |
| 453680 | AL079647 | Hs. 14485 | ESTs | 17.5 |
| 400202 | | | predicted exon | 17.5 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 410768 | AF038185 | Hs. 66187 | Homo sapiens clone 23700 mRNA sequence | 17.5 |
| 409932 | AI376750 | Hs. 57600 | adaptor-related protein complex 1, sigma 1 subunit | 17.5 |
| 425563 | AF084199 | Hs. 299837 | ESTs | 17.5 |
| 440475 | AI807671 | Hs. 128343 | ESTs | 17.5 |
| 452767 | AW014195 | Hs. 61472 | ESTs, Weakly similar to unknown [S. cerevisiae] | 17.5 |
| 410570 | AI133096 | Hs. 64593 | ATP synthase, H+ transporting, mitochondrial F1F0, su | 17.4 |
| 419600 | AA448958 | Hs. 91481 | NEU1 protein | 17.4 |
| 419588 | AI347205 | Hs. 91375 | Human clone 23614 mRNA sequence | 17.4 |
| 428975 | NM_004672 | Hs. 194694 | mitogen-activated protein kinase kinase kinase 6 | 17.4 |
| 448928 | AI350260 | Hs. 5384 | Homo sapiens cDNA FLJ11743 fis. clone HEMBA100 | 17.4 |
| 403924 | | | predicted exon | 17.4 |
| 419889 | AA251600 | | gb: zs10d12 r1 NCI_CGAP_GCB1 Homo sapiens cDNA | 17.4 |
| 405023 | AW408800 | Hs. 104859 | hypothetical protein DKFZp762E1312 | 17.4 |
| 426065 | N32049 | | gb: yw96g08 s1 Soares_placenta_8to9weeks_2NbHP8to | 17.4 |
| 453199 | AI336266 | Hs. 301854 | Homo sapiens PRO0412 mRNA, complete cds | 17.4 |
| 455132 | AW857955 | | gb: PM0-CT0325-151299-002-A12 CT0325 Homo sapi | 17.4 |
| 442932 | AA457211 | Hs. 8858 | bromodomain adjacent to zinc finger domain, 1A | 17.4 |
| 432065 | AA401039 | Hs. 2903 | protein phosphatase 4 (formerly X), catalytic subunit | 17.3 |
| 444652 | BE513613 | Hs. 11538 | actin related protein 2/3 complex, subunit 1A (41 kD) | 17.3 |
| 417935 | R53697 | Hs. 170044 | ESTs | 17.3 |
| 430050 | AA430993 | Hs. 227913 | API5-like 1 | 17.3 |
| 446272 | BE268912 | Hs. 14601 | hematopoietic cell-specific Lyn substrate 1 | 17.3 |
| 425996 | W67330 | Hs. 81256 | S100 calcium-binding protein A4 (calcium protein, calv | 17.3 |
| 416964 | D87467 | Hs. 80620 | guanine nucleotide exchange factor for Rap1, M-Ras-re | 17.3 |
| 437418 | AI478954 | Hs. 59459 | ESTs | 17.3 |
| 447255 | AI884908 | Hs. 158607 | ESTs | 17.3 |
| 402203 | | | predicted exon | 17.3 |
| 417611 | AW993983 | | gb: RC1-BN0035-130400-013-a04 BN0035 Homo sapie | 17.3 |
| 426560 | AA381661 | Hs. 119878 | ESTs | 17.3 |
| 446163 | AA026880 | Hs. 25252 | Homo sapiens cDNA FLJ13603 fis, clone PLACE1010 | 17.3 |
| 445017 | AI205493 | Hs. 176860 | ESTs | 17.3 |
| 438658 | AI222068 | Hs. 123571 | ESTs | 17.3 |
| 442238 | AW135374 | Hs. 270949 | ESTs | 17.3 |
| 443195 | BE148235 | Hs. 193063 | Homo sapiens cDNA FLJ14201 fis, clone NT2RP3002 | 17.3 |
| 442609 | AL020996 | Hs. 8518 | selenoprotein N | 17.2 |
| 416591 | AA091976 | Hs. 79387 | proteasome (prosome, macropain) 26S subunit ATPase | 17.2 |
| 403674 | | | predicted exon | 17.2 |
| 430514 | AA318501 | Hs. 241587 | megakaryocyte-enhanced gene transcript 1 protein | 17.2 |
| 411696 | AW857404 | | gb: CM3-CT0313-291199-046-c11 CT0313 Homo sapie | 17.2 |
| 434560 | R13052 | Hs. 3964 | Homo sapiens clone 24877 mRNA sequence | 17.2 |
| 422627 | BE336857 | Hs. 118787 | transforming growth factor, beta-induced, 68 kD | 17.2 |
| 414364 | D38521 | Hs. 75935 | KIAA0077 protein | 17.2 |
| 409119 | AA531133 | Hs. 4253 | G protein-coupled receptor 44 | 17.2 |
| 425640 | U34051 | Hs. 299204 | ESTs, Highly similar to CD5S_HUMAN CYCLIN-DE | 17.2 |
| 436044 | BE247571 | Hs. 15627 | Nit protein 2 | 17.2 |
| 401657 | | | predicted exon | 17.2 |
| 449763 | AI822112 | Hs. 118241 | ESTs | 17.2 |
| 409601 | AF237621 | Hs. 80828 | keratin 1 (epidermolytic hyperkeratosis) | 17.2 |
| 449636 | AI656608 | Hs. 281328 | ESTs | 17.2 |
| 444958 | AW292643 | Hs. 167047 | ESTs | 17.2 |
| 429978 | AA249027 | Hs. 241507 | ribosomal protein S6 | 17.2 |
| 453043 | AW136440 | Hs. 224277 | ESTs | 17.2 |
| 458640 | AI284935 | | gb: qk55g09.x1 NCI_CGAP_Co8 Homo sapiens cDNA | 17.1 |
| 456329 | T41418 | | gb: ph1h3_19/1TV Outward Alu-primed hncDNA librar | 17.1 |
| 414839 | X63692 | Hs. 77462 | DNA (cytosine-5-)-methyltransferase 1 | 17.1 |
| 403662 | | | predicted exon | 17.1 |
| 411651 | AW855392 | | gb: CM3-CT0275-191099-024-e12 CT0275 Homo sapie | 17.1 |
| 404097 | | | predicted exon | 17.1 |
| 447252 | R90916 | | gb: yn01e10.r1 Soares adult brain N2b4HB55Y Homo s | 17.1 |
| 430024 | AI808780 | Hs. 227730 | integrin, alpha 6 | 17.1 |
| 412828 | AL133396 | Hs. 74621 | prion protein (p27–30) (Creutzfeld-Jakob disease, Gerst | 17.1 |
| 444558 | AW181975 | Hs. 165892 | ESTs | 17.1 |
| 420869 | X58964 | Hs. 123638 | regulatory factor X, 1 (influences HLA class II expressi | 17.1 |
| 448812 | H30775 | Hs. 22140 | BM88 antigen | 17.0 |
| 431777 | AA570296 | Hs. 105470 | found in inflammatory zone 1 | 17.0 |
| 422007 | AI739435 | Hs. 39168 | ESTs | 17.0 |
| 403051 | | | predicted exon | 17.0 |
| 402427 | | | predicted exon | 17.0 |
| 417408 | F17211 | Hs. 86092 | Human DNA sequence from clone RP11-243J16 on chr | 17.0 |
| 450598 | AF151076 | Hs. 25199 | hypothetical protein | 17.0 |
| 421121 | AA459028 | Hs. 86228 | TRIAD3 protein | 17.0 |
| 458488 | AL040565 | Hs. 209544 | ESTs | 17.0 |
| 417158 | AW965223 | Hs. 110062 | ESTs, Weakly similar to ACR3_HUMAN 30 KD ADIP | 17.0 |
| 439318 | AW837046 | Hs. 6527 | G protein-coupled receptor 56 | 17.0 |
| 428758 | AA433988 | Hs. 98502 | Homo sapiens cDNA FLJ14303 fis, clone PLACE2000 | 17.0 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 447572 | AI631546 | Hs. 159732 | ESTs | 17.0 |
| 434434 | AA633516 | Hs. 157201 | ESTs | 17.0 |
| 409994 | D86864 | Hs. 57735 | acetyl LDL receptor; SREC | 17.0 |
| 408927 | AW295650 | Hs. 255453 | ESTs | 17.0 |
| 439093 | AA534163 | Hs. 5476 | serine protease inhibitor, Kazal type, 5 | 17.0 |
| 454466 | AA984138 | Hs. 279895 | *Homo sapiens* mRNA for KIAA1578 protein, partial cd | 17.0 |
| 426996 | AW968934 | Hs. 173108 | *Homo sapiens* cDNA FLJ21897 fis, clone HEP03447, | 17.0 |
| 436659 | AI217900 | Hs. 144464 | ESTs | 17.0 |
| 422731 | AL138411 | | gb: DKFZp434A1229_r1 434 (synonym htes3) Homo s | 17.0 |
| 429294 | AA095971 | Hs. 198793 | KIAA0750 gene product | 17.0 |
| 432847 | BE266941 | Hs. 279554 | proteasome (prosome, macropain) 26S subunit, non-AT | 16.9 |
| 416977 | AW130242 | Hs. 293476 | ESTs | 16.9 |
| 406827 | AA971409 | Hs. 84298 | CD74 antigen (invariant polypeptide of major histocom | 16.9 |
| 453758 | U83527 | | gb: HSU83527 Human fetal brain (M Lovett) Homo sap | 16.9 |
| 431314 | AI732204 | Hs. 105423 | ESTs | 16.9 |
| 423185 | BE299590 | Hs. 125078 | ornithine decarboxylase antizyme 1 | 16.9 |
| 435086 | AW975243 | Hs. 122596 | ESTs | 16.9 |
| 447383 | N24231 | | gb: yx22a11 r1 Soares melanocyte 2NbHM Homo sapie | 16.9 |
| 456251 | R13326 | Hs. 21303 | ESTs | 16.9 |
| 456327 | H68741 | Hs. 38774 | ESTs | 16.9 |
| 450594 | N31036 | | gb: yx51g04 r1 Soares melanocyte 2NbHM Homo sapie | 16.9 |
| 428177 | AA423967 | Hs. 178113 | ESTs, Moderately similar to kinesin like protein 9 [M m | 16.9 |
| 453250 | AI346520 | Hs. 121619 | chromosome 11 open reading frame 15 | 16.9 |
| 418546 | AF061739 | Hs. 83954 | protein associated with PRK1 | 16.9 |
| 446546 | BE167687 | Hs. 156628 | ESTs | 16.9 |
| 421100 | AW351839 | Hs. 124660 | *Homo sapiens* cDNA FLJ21763 fis, clone COLF6967 | 16.9 |
| 455993 | BE179085 | | gb: RC0-HT0613-140300-021-d06 HT0613 Homo sapie | 16.9 |
| 459375 | BE251770 | | gb: 601112470F1 NIH_MGC_16 *Homo sapiens* cDNA | 16.9 |
| 454803 | AW860148 | | gb: RC0-CT0379-290100-032-b10 CT0379 Homo sapie | 16.9 |
| 445474 | AI240014 | Hs. 259558 | ESTs | 16.9 |
| 443198 | AI039813 | | gb: ox49d06.x1 Soares_total_fetus_Nb2HF8_9w Homo | 16.9 |
| 441557 | AW452647 | Hs. 270482 | ESTs | 16.9 |
| 420206 | M91463 | Hs. 95958 | solute carrier family 2 (facilitated glucose transporter), | 16.9 |
| 442202 | BE272862 | Hs. 106534 | *Homo sapiens* cDNA: FLJ22625 fis, clone HSI06009 | 16.9 |
| 416913 | AW934714 | | gb: RC1-DT0001-031299-011-a11 DT0001 Homo sapie | 16.9 |
| 419355 | AA428520 | Hs. 90061 | progesterone binding protein | 16.9 |
| 452975 | M85521 | Hs. 69469 | dendritic cell protein | 16.9 |
| 432525 | AI796096 | Hs. 109414 | ESTs | 16.8 |
| 453718 | AL119317 | Hs. 120360 | phospholipase A2, group VI (cytosolic. calcium-indepe | 16.8 |
| 437270 | R18087 | Hs. 11282 | ESTs, Weakly similar to cleft lip and palate transmemb | 16.8 |
| 408007 | AW135965 | Hs. 246783 | ESTs | 16.8 |
| 450954 | AI904740 | Hs. 25691 | receptor (calcitonin) activity modifying protein 3 | 16.8 |
| 402958 | | | predicted exon | 16.8 |
| 445656 | W22050 | Hs. 21299 | ESTs, Weakly similar to AF151840_1 CGI-82 protein [H. | 16.8 |
| 410684 | AA088500 | Hs. 170298 | ESTs | 16.8 |
| 437669 | AI358105 | Hs. 123164 | ESTs, Weakly similar to match to ESTs AA667999 [H. | 16.8 |
| 447869 | AW139113 | Hs. 164307 | ESTs | 16.8 |
| 458025 | AI275406 | | gb: ql63c10 x1 Soares_NhHMPu_S1 *Homo sapiens* cDN | 16.8 |
| 445614 | AV660763 | Hs. 110675 | apolipoprotein C-IV | 16.8 |
| 454610 | AW810224 | | gb:MR4-ST0125-021199-017-e07 ST0125 Homo sapie | 16.8 |
| 449303 | AK001495 | Hs. 23467 | hypothetical protein FLJ10633 | 16.8 |
| 422105 | AI929700 | Hs. 111680 | endosulfine alpha | 16.8 |
| 444788 | AI871122 | Hs. 202821 | ESTs | 16.8 |
| 414057 | AI815559 | Hs. 75730 | signal recognition particle receptor ('docking protein') | 16.8 |
| 408822 | AW500715 | Hs. 57079 | *Homo sapiens* cDNA FLJ13267 fis, clone OVARC1000 | 16.8 |
| 433379 | AA586368 | Hs. 190232 | ESTs | 16.8 |
| 441552 | AA937975 | | gb: oc08e12 s1 NCI_CGAP_GCB1 *Homo sapiens* cDN | 16.8 |
| 403582 | | | predicted exon | 16.8 |
| 433871 | W02410 | Hs. 205555 | ESTs | 16.8 |
| 439509 | AF086332 | Hs. 58314 | ESTs | 16.8 |
| 431639 | AK000680 | Hs. 266175 | phosphoprotein associated with GEMs | 16.8 |
| 430129 | BE301708 | Hs. 233955 | hypothetical protein FLJ20401 | 16.8 |
| 401465 | | | predicted exon | 16.8 |
| 448913 | AA194422 | Hs. 22564 | myosin VI | 16.8 |
| 410261 | AF145713 | Hs. 61490 | schwannomin interacting protein 1 | 16.8 |
| 421199 | BE244219 | Hs. 102497 | paxillin | 16.7 |
| 450489 | AI697990 | Hs. 224375 | ESTs | 16.7 |
| 410186 | AW602528 | | gb: RC5-BT0562-260100-011-A02 BT0562 Homo sapi | 16.7 |
| 447224 | BE617125 | | gb: 601441664F1 NIH_MGC_65 *Homo sapiens* cDNA | 16.7 |
| 403010 | | | predicted exon | 16.7 |
| 404881 | | | predicted exon | 16.7 |
| 445572 | AI243445 | Hs. 189654 | ESTs | 16.7 |
| 419440 | AB020689 | Hs. 90419 | KIAA0882 protein | 16.7 |
| 443406 | AI056238 | Hs. 143316 | ESTs | 16.7 |
| 457901 | AW207023 | Hs. 250497 | ESTs, Highly similar to dJ745C22 1 [*H. sapiens*] | 16.7 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 448364 | T08958 | Hs. 16561 | HSPC141 protein | 16.6 |
| 407239 | AA076350 | Hs. 67846 | leukocyte immunoglobulin-like receptor, subfamily B ( | 16.6 |
| 401847 | | | predicted exon | 16.6 |
| 429523 | AK000788 | Hs. 205280 | *Homo sapiens* cDNA FLJ20781 fis, clone COL04235 | 16.6 |
| 432845 | AI989751 | Hs. 150378 | ESTs | 16.6 |
| 400246 | | | predicted exon | 16.6 |
| 404971 | | | predicted exon | 16.6 |
| 422954 | AW998605 | Hs. 32399 | ESTs, Weakly similar to Similar to Ena-VASP like prot | 16.6 |
| 415042 | NM_006759 | Hs. 77837 | UDP-glucose pyrophosphorylase 2 | 16.6 |
| 432201 | AI538613 | Hs. 135657 | ESTs | 16.6 |
| 456993 | AL134577 | Hs. 200302 | ESTs | 16.6 |
| 456525 | AW468397 | Hs. 100000 | S100 calcium-binding protein A8 (calgranulin A) | 16.6 |
| 444060 | AA340277 | Hs. 10248 | *Homo sapiens* cDNA FLJ20167 fis, clone COL09512 | 16.6 |
| 428928 | BE409838 | Hs. 194657 | cadherin 1, type 1, E-cadherin (epithelial) | 16.6 |
| 448199 | AI953278 | Hs. 170557 | ESTs | 16.6 |
| 443422 | R10288 | Hs. 301529 | ESTs | 16.6 |
| 401117 | | | predicted exon | 16.6 |
| 400613 | | | predicted exon | 16.6 |
| 431214 | AA294921 | Hs. 250811 | v-ral simian leukemia viral oncogene homolog B (ras re | 16.6 |
| 431649 | AL133077 | Hs. 266746 | *Homo sapiens* cDNA FLJ22615 fis, clone HSI05118 | 16.5 |
| 421335 | X99977 | Hs. 103505 | ARS component B | 16.5 |
| 427154 | AL137262 | Hs. 288991 | *Homo sapiens* cDNA FLJ22523 fis, clone HRC12507 | 16.5 |
| 401010 | | | predicted exon | 16.5 |
| 436678 | BE512828 | Hs. 5273 | NADH dehydrogenase (ubiquinone) Fe-S protein 3 (30 k | 16.5 |
| 401589 | | | predicted exon | 16.5 |
| 402538 | | | predicted exon | 16.5 |
| 430478 | NM_014349 | Hs. 241535 | TNF-inducible protein CG12-1 | 16.5 |
| 437623 | D63880 | Hs. 5719 | chromosome condensation-related SMC-associated pro | 16.5 |
| 401244 | | | predicted exon | 16.5 |
| 415167 | AA160784 | Hs. 26410 | ESTs | 16.5 |
| 438291 | BE514605 | Hs. 289092 | *Homo sapiens* cDNA FLJ22380 fis, clone HRC07453, | 16.5 |
| 405183 | | | predicted exon | 16.5 |
| 436480 | AJ271643 | Hs. 87469 | putative acid-sensing ion channel | 16.5 |
| 456691 | AI023428 | Hs. 205696 | ESTs | 16.5 |
| 418332 | R34976 | Hs. 78293 | ESTs | 16.5 |
| 446052 | AA358760 | | gb: EST67699 Fetal lung II *Homo sapiens* cDNA 5' end | 16.5 |
| 444859 | AW449137 | Hs. 157487 | ESTs | 16.5 |
| 437192 | AW975786 | Hs. 75355 | ubiquitin-conjugating enzyme E2N (homologous to yea | 16.5 |
| 400891 | | | predicted exon | 16.5 |
| 448372 | AW445166 | Hs. 170802 | ESTs | 16.5 |
| 425798 | AA364002 | | gb: EST74529 Pineal gland II *Homo sapiens* cDNA 5' en | 16.5 |
| 459253 | AL157476 | Hs. 32913 | *Homo sapiens* mRNA, cDNA DKFZp761C082 (from c | 16.5 |
| 420746 | AW195932 | Hs. 197488 | ESTs | 16.4 |
| 414717 | BE271039 | Hs. 77060 | proteasome (prosome, macropain) subunit, beta type, 6 | 16.4 |
| 400727 | | | predicted exon | 16.4 |
| 422691 | NM_003365 | Hs. 119251 | ubiquinol-cytochrome c reductase core protein I | 16.4 |
| 405639 | | | predicted exon | 16.4 |
| 414444 | BE298594 | | gb: 601119754F1 NIH_MGC_17 *Homo sapiens* cDNA | 16.4 |
| 456146 | AL034349 | Hs. 79005 | protein tyrosine phosphatase, receptor type, K | 16.4 |
| 414610 | BE388044 | | gb: 601283747F1 NIH_MGC_44 *Homo sapiens* cDNA | 16.4 |
| 414267 | AL078459 | Hs. 289109 | dimethylarginine dimethylaminohydrolase 1 | 16.4 |
| 401268 | | | predicted exon | 16.4 |
| 403613 | | | predicted exon | 16.4 |
| 414203 | BE262170 | | gb: 601150419F1 NIH_MGC_19 *Homo sapiens* cDNA | 16.4 |
| 454315 | AW373564 | Hs. 251928 | nuclear pore complex interacting protein | 16.4 |
| 452114 | N22687 | Hs. 8236 | ESTs | 16.4 |
| 404638 | | | predicted exon | 16.4 |
| 404600 | | | predicted exon | 16.3 |
| 448855 | AF070574 | Hs. 22316 | *Homo sapiens* clone 24819 mRNA sequence | 16.3 |
| 406629 | AW277078 | Hs. 181165 | eukaryotic translation elongation factor 1 alpha 1 | 16.3 |
| 450957 | BE515202 | Hs. 21497 | *Homo sapiens* mRNA for FLJ00042 protein, partial cds | 16.3 |
| 449966 | H60542 | Hs. 37848 | ESTs | 16.3 |
| 402585 | | | predicted exon | 16.3 |
| 436008 | AI078428 | Hs. 58785 | ESTs | 16.3 |
| 401492 | | | predicted exon | 16.3 |
| 412288 | NM_003005 | Hs. 73800 | selectin P (granule membrane protein 140 kD, antigen C | 16.3 |
| 405088 | | | predicted exon | 16.3 |
| 437345 | BE259522 | Hs. 5556 | NADH dehydrogenase (ubiquinone) 1, alpha/beta subco | 16.3 |
| 432280 | BE440142 | Hs. 2943 | signal recognition particle 19 kD | 16.3 |
| 419596 | BE379320 | Hs. 91448 | MKP-1 like protein tyrosine phosphatase | 16.3 |
| 428801 | AW277121 | Hs. 254881 | ESTs | 16.3 |
| 431394 | AK000692 | Hs. 252351 | HERV-H LTR-associating 2 | 16.3 |
| 452998 | BE019681 | Hs. 6019 | *Homo sapiens* cDNA: FLJ21288 fis, clone COL01927 | 16.3 |
| 439938 | AI147392 | Hs. 124607 | ESTs | 16.3 |
| 418844 | M62982 | Hs. 1200 | arachidonate 12-lipoxygenase | 16.3 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 446081 | AA972412 | Hs. 13755 | f-box and WD-40 domain protein 2 | 16.3 |
| 443534 | AI076123 | | gb: oy92e04.x1 Soares_fetal_liver_spleen_1NFLS_S1 H. | 16.3 |
| 459510 | AA076706 | | gb: 7B01B02 Chromosome 7 Fetal Brain cDNA Library | 16.3 |
| 450517 | AI523755 | Hs. 59236 | ESTs, Weakly similar to B35049 ankyrin 1, erythrocyte | 16.3 |
| 451938 | AI354355 | Hs. 16697 | down-regulator of transcription 1, TBP-binding (negativ | 16.3 |
| 454478 | AW805749 | | gb: QV1-UM0105-180400-162-f10 UM0105 Homo sap | 16.2 |
| 407214 | AA412048 | Hs. 279574 | CGI-39 protein, cell death-regulatory protein GRIM19 | 16.2 |
| 406580 | | | predicted exon | 16.2 |
| 409452 | BE336714 | Hs. 289271 | cytochrome c-1 | 16.2 |
| 416841 | N33878 | Hs. 249495 | heterogeneous nuclear ribonucleoprotein A1 | 16.2 |
| 458710 | AV660856 | | gb: AV660856 GLC *Homo sapiens* cDNA clone GLCG | 16.2 |
| 450657 | AK001579 | Hs. 25277 | hypothetical protein FLJ21065 | 16.2 |
| 404230 | | | predicted exon | 16.2 |
| 439471 | W69839 | Hs. 58033 | ESTs | 16.2 |
| 400848 | | | predicted exon | 16.2 |
| 428797 | AA496205 | Hs. 193700 | *Homo sapiens* mRNA, cDNA DKFZp586I0324 (from c | 16.2 |
| 416272 | AA178882 | | gb: zp38b09 r1 Stratagene muscle 937209 *Homo sapiens* | 16.2 |
| 444465 | AI206592 | Hs. 143843 | ESTs | 16.2 |
| 431257 | AF039597 | | gb: *Homo sapiens* Ku86 autoantigen related protein 1 (K | 16.2 |
| 447775 | BE179318 | | gb: RC1-HT0615-290300-021-g05 HT0615 Homo sapie | 16.2 |
| 403833 | | | predicted exon | 16.2 |
| 444140 | AV648089 | Hs. 282383 | ESTs | 16.2 |
| 446102 | AW168067 | Hs. 252956 | ESTs | 16.2 |
| 416475 | T70298 | | gb: yd26g02.s1 Soares fetal liver spleen 1NFLS Homo s | 16.2 |
| 430783 | AW971248 | Hs. 291289 | ESTs, Weakly similar to ALU1_HUMAN ALU SUBFA | 16.2 |
| 414070 | AW963783 | | gb: EST375856 MAGE resequences, MAGH Homo sap | 16.2 |
| 444283 | AI138971 | Hs. 154636 | ESTs | 16.2 |
| 405599 | X92715 | Hs. 3057 | zinc finger protein 74 (Cos52) | 16.2 |
| 409427 | AW389668 | | gb: RC2-ST0168-071299-013-f06 ST0168 Homo sapien | 16.2 |
| 409417 | AA156247 | Hs. 295908 | ESTs, Weakly similar to ALU7_HUMAN ALU SUBFA | 16.2 |
| 435380 | AA679001 | Hs. 192221 | ESTs | 16.2 |
| 406752 | AI285598 | Hs. 217493 | annexin A2 | 16.2 |
| 406096 | F12200 | Hs. 5811 | chromosome 21 open reading frame 59 | 16.2 |
| 417551 | AI816291 | Hs. 82273 | hypothetical protein | 16.2 |
| 441252 | AW360901 | Hs. 183047 | ESTs, Weakly similar to unnamed protein product [H. s | 16.2 |
| 419608 | AL037237 | Hs. 91586 | transmembrane 9 superfamily member 1 | 16.1 |
| 438894 | AI630819 | Hs. 300431 | ESTs | 16.1 |
| 451287 | AK002158 | Hs. 26194 | hypothetical protein FLJ11296 | 16.1 |
| 412499 | AW956916 | Hs. 11238 | KIAA0622 protein, Drosophila "multiple asters" (Mast | 16.1 |
| 433355 | AI808235 | | gb: wf44e01 x1 Soares_NFL_T_GBC_S1 Homo sapien | 16.1 |
| 416818 | AI986408 | Hs. 204766 | ESTs, Weakly similar to B48013 proline-rich proteogly | 16.1 |
| 438765 | AI031888 | Hs. 132594 | ESTs | 16.1 |
| 424470 | BE244261 | Hs. 5615 | nuclear RNA export factor 1 | 16.1 |
| 416194 | H27114 | Hs. 301212 | ESTs | 16.1 |
| 446702 | R44518 | Hs. 143496 | ESTs | 16.1 |
| 414222 | AL135173 | Hs. 878 | sorbitol dehydrogenase | 16.1 |
| 443122 | AI806656 | Hs. 209022 | ESTs, Weakly similar to Pro-Pol-dUTPase polyprotein | 16.1 |
| 448648 | BE614345 | Hs. 159089 | ESTs | 16.1 |
| 456394 | W28506 | | gb: 48f1 Human retina cDNA randomly primed sublibra | 16.1 |
| 445887 | AI263105 | Hs. 145597 | ESTs | 16.1 |
| 412332 | AW937661 | Hs. 288324 | *Homo sapiens* cDNA FLJ13283 fis, clone OVARC1001 | 16.1 |
| 403912 | | | predicted exon | 16.1 |
| 441446 | R66269 | Hs. 28714 | ESTs | 16.1 |
| 403153 | | | predicted exon | 16.0 |
| 444907 | AW772596 | Hs. 148586 | ESTs | 16.0 |
| 421946 | R99629 | Hs. 109773 | hypothetical protein FLJ20625 | 16.0 |
| 437513 | AW410681 | Hs. 5648 | proteasome (prosome, macropain) 26S subunit, non-AT | 16.0 |
| 407752 | AA573581 | Hs. 13328 | ESTs | 16.0 |
| 447953 | AI804218 | Hs. 209614 | *Homo sapiens* cDNA FLJ22343 fis, clone HRC06043 | 16.0 |
| 425708 | AK001342 | Hs. 14570 | *Homo sapiens* cDNA FLJ22530 fis, clone HRC12866 | 16.0 |
| 421449 | AA713491 | Hs. 291501 | ESTs | 16.0 |
| 418323 | NM_002118 | Hs. 1162 | major histocompatibility complex, class II, DM beta | 16.0 |
| 447787 | BE620108 | | gb: 601483015F1 NIH_MGC_69 *Homo sapiens* cDNA | 16.0 |
| 422716 | AI702835 | Hs. 124475 | ESTs | 16.0 |
| 443958 | BE241880 | Hs. 10029 | cathepsin C | 16.0 |
| 417908 | AA207221 | | gb: zq55h04.s1 Stratagene neuroepithelium (937231) Ho | 16.0 |
| 438542 | AA810131 | Hs. 123317 | ESTs | 16.0 |
| 400288 | X06256 | Hs. 149609 | integrin, alpha 5 (fibronectin receptor, alpha polypeptid | 16.0 |
| 456825 | H67220 | Hs. 146406 | nitrilase 1 | 16.0 |
| 431360 | NM_000427 | Hs. 251680 | loncrin | 16.0 |
| 414266 | BE267834 | | gb: 601124428F1 NIH_MGC_8 *Homo sapiens* cDNA c | 16.0 |
| 440571 | AA904461 | Hs. 130798 | ESTs | 16.0 |
| 426075 | AW513691 | Hs. 270149 | ESTs | 16.0 |
| 413488 | BE144017 | Hs. 184693 | transcription elongation factor B (SIII), polypeptide 1 (1 | 16.0 |
| 446767 | AI380107 | Hs. 158954 | ESTs | 16.0 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 418008 | W56044 | Hs. 211556 | *Homo sapiens* cDNA FLJ23378 fis, clone HEP16248 | 16.0 |
| 404239 | | | predicted exon | 16.0 |
| 458401 | AW236939 | Hs. 172154 | ESTs | 16.0 |
| 412955 | BE241849 | Hs. 75082 | ras homolog gene family, member G (rho G) | 15.9 |
| 423072 | AI792946 | Hs. 123116 | solute carrier family 12 (sodium/potassium/chloride tran | 15.9 |
| 444954 | AW247076 | Hs. 12163 | eukaryotic translation initiation factor 2, subunit 2 (beta | 15.9 |
| 449023 | AI623261 | Hs. 248875 | ESTs | 15.9 |
| 435729 | BE048886 | Hs. 275017 | EST | 15.9 |
| 438575 | BE304709 | Hs. 146550 | myosin, heavy polypeptide 9, non-muscle | 15.9 |
| 413047 | H02209 | | gb: yj38c09.r1 Soares placenta Nb2HP *Homo sapiens* cD | 15.9 |
| 425997 | AK000086 | Hs. 165948 | hypothetical protein FLJ20079 | 15.9 |
| 446863 | AW614370 | Hs. 254620 | ESTs | 15.9 |
| 448564 | AL044962 | Hs. 21453 | *Homo sapiens* mRNA for inositol 1,4,5-trisphosphate 3 | 15.9 |
| 455640 | BE064059 | | gb: QV3-BT0296-010300-111-e04 BT0296 Homo sapie | 15.9 |
| 404345 | AA730407 | Hs. 159156 | protocadhenn 11 | 15.9 |
| 418512 | AW498974 | Hs. 89981 | diacylglycerol kinase, zeta (104 kD) | 15.9 |
| 411551 | AW851309 | | gb: IL3-CT0220-170200-067-C11 CT0220 Homo sapien | 15.9 |
| 446726 | AW300144 | Hs. 209209 | *Homo sapiens* cDNA FLJ11629 fis, clone HEMBA100 | 15.9 |
| 410748 | BE383816 | Hs. 136005 | ESTs, Highly similar to bG115G20 2 [*H. sapiens*] | 15.9 |
| 449618 | AI076459 | Hs. 14366 | *Homo sapiens* cDNA FLJ12819 fis, clone NT2RP2002 | 15.9 |
| 429697 | AW296451 | Hs. 24605 | ESTs | 15.9 |
| 424012 | AW368377 | Hs. 137569 | tumor protein 63 kDa with strong homology to p53 | 15.9 |
| 403151 | | | predicted exon | 15.8 |
| 452363 | AI582743 | Hs. 94953 | ESTs, Highly similar to C1QC_HUMAN COMPLEME | 15.8 |
| 425971 | AF135024 | Hs. 165296 | kallikrein 13 | 15.8 |
| 432826 | X75363 | Hs. 250770 | kallikrein 15 | 15.8 |
| 431972 | AI805145 | Hs. 191711 | ESTs | 15.8 |
| 400269 | | | predicted exon | 15.8 |
| 404703 | AI904493 | Hs. 99890 | polymerase (DNA directed), delta 1, catalytic subunit (1 | 15.8 |
| 449335 | AW150717 | Hs. 296176 | STAT induced STAT inhibitor 3 | 15.8 |
| 418443 | NM_005239 | Hs. 85146 | v-ets avian erythroblastosis virus E26 oncogene homolo | 15.8 |
| 445773 | H73456 | Hs. 13299 | *Homo sapiens* mRNA, cDNA DKFZp761M0111 (from | 15.8 |
| 433782 | AF090945 | | gb: *Homo sapiens* clone HQ0670 | 15.8 |
| 406473 | | | predicted exon | 15.8 |
| 420831 | AA280824 | Hs. 190035 | ESTs | 15.8 |
| 402939 | | | predicted exon | 15.8 |
| 405196 | | | predicted exon | 15.8 |
| 452947 | AW130413 | | gb: xf50f04 x1 NCI_CGAP_Gas4 *Homo sapiens* cDNA | 15.8 |
| 414170 | AA335996 | Hs. 3743 | matrix metalloproteinase 24 (membrane-inserted) | 15.8 |
| 437133 | AB018319 | Hs. 5460 | KIAA0776 protein | 15.8 |
| 458356 | AI024855 | Hs. 131575 | ESTs | 15.8 |
| 407857 | AI928445 | Hs. 92254 | hypothetical protein FLJ20163 | 15.8 |
| 405687 | | | predicted exon | 15.8 |
| 415189 | L34657 | Hs. 78146 | platelet/endothelial cell adhesion molecule (CD31 antig | 15.8 |
| 408662 | AW247699 | Hs. 105897 | ESTs | 15.7 |
| 448338 | AI492857 | | gb: th72h08 x1 Soares_NhHMPu_S1 *Homo sapiens* cDN | 15.7 |
| 402694 | | | predicted exon | 15.7 |
| 430224 | AW675175 | Hs. 235975 | hypothetical protein DKFZp434D0412 | 15.7 |
| 458792 | N56666 | | gb: yw75e02 r1 Soares_placenta_8to9weeks_2NbHP8to | 15.7 |
| 402944 | | | predicted exon | 15.7 |
| 422675 | BE018517 | Hs. 119140 | eukaryotic translation initiation factor 5A | 15.7 |
| 408661 | AW247625 | | gb: 2820094 5prime NIH_MGC_7 *Homo sapiens* cDNA | 15.7 |
| 423238 | AA323569 | Hs. 280482 | ESTs | 15.7 |
| 421517 | AB018352 | Hs. 105399 | KIAA0809 protein | 15.7 |
| 429865 | AB023217 | Hs. 225968 | KIAA1000 protein | 15.7 |
| 440815 | AW071945 | Hs. 7436 | putative acyltransferase | 15.7 |
| 400634 | | | predicted exon | 15.7 |
| 451034 | AL050341 | Hs. 25846 | zinc metalloproteinase, STE24 (yeast, homolog) | 15.7 |
| 457571 | AI375726 | Hs. 279918 | hypothetical protein | 15.7 |
| 450105 | BE281124 | Hs. 288013 | similar to yeast BET3 (*S. cerevisiae*) | 15.7 |
| 407464 | AJ276396 | | gb: *Homo sapiens* mRNA for matrix extracellular phosp | 15.7 |
| 439465 | AF086285 | | gb: *Homo sapiens* full length insert cDNA clone ZD47B | 15.7 |
| 451837 | T92157 | Hs. 16970 | ESTs | 15.7 |
| 435313 | AI769400 | Hs. 189729 | ESTs | 15.7 |
| 402738 | | | predicted exon | 15.7 |
| 432966 | AA650114 | | gb: ns92h09 s1 NCI_CGAP_Pr3 *Homo sapiens* cDNA c | 15.7 |
| 457666 | AW470302 | Hs. 129663 | ESTs | 15.7 |
| 401269 | | | predicted exon | 15.7 |
| 427509 | M62505 | Hs. 2161 | complement component 5 receptor 1 (C5a ligand) | 15.7 |
| 418846 | AI821602 | Hs. 115127 | ESTs | 15.6 |
| 448891 | AI587332 | Hs. 209115 | ESTs | 15.6 |
| 445930 | AF055009 | Hs. 13456 | *Homo sapiens* clone 24747 mRNA sequence | 15.6 |
| 421254 | AK001724 | Hs. 102950 | coat protein gamma-cop | 15.6 |
| 447073 | AW204821 | Hs. 157726 | ESTs | 15.6 |
| 445438 | AB014578 | Hs. 12707 | KIAA0678 protein | 15.6 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 432126 | AA865239 | Hs. 55144 | ESTs | 15.6 |
| 424091 | AF235097 | Hs. 139263 | calcium channel, voltage-dependent, alpha 1F subunit | 15.6 |
| 440832 | AI057548 | Hs. 128224 | ESTs | 15.6 |
| 449228 | AJ403107 | Hs. 148590 | ESTs, Weakly similar to AF208846 1 BM-004 [H. sapie | 15.6 |
| 434253 | AI393345 | Hs. 116215 | ESTs | 15.6 |
| 459270 | AL039604 | | gb: DKFZp434E2211_r1 434 (synonym htes3) Homo s | 15.6 |
| 454425 | AW300927 | Hs. 27192 | hypothetical protein dJ1057B20 2 | 15.6 |
| 412055 | AA099907 | Hs. 271806 | ESTs | 15.6 |
| 400837 | | | predicted exon | 15.6 |
| 458866 | BE616694 | Hs. 288042 | *Homo sapiens* cDNA FLJ14299 fis, clone PLACE1010 | 15.6 |
| 417124 | BE122762 | Hs. 25338 | ESTs | 15.6 |
| 414376 | BE393856 | Hs. 66915 | ESTs, Weakly similar to 16.7 Kd protein [*H. sapiens*] | 15.6 |
| 418636 | AW749855 | | gb: QV4-BT0534-281299-053-c05 BT0534 Homo sapie | 15.6 |
| 454128 | AL031259 | Hs. 41639 | programmed cell death 2 | 15.6 |
| 441074 | AW500001 | Hs. 4783 | *Homo sapiens* cDNA. FLJ22035 fis, clone HEP08838 | 15.6 |
| 451742 | T77609 | Hs. 117970 | ankyrin 2, neuronal | 15.6 |
| 403687 | | | predicted exon | 15.6 |
| 431838 | AI097229 | Hs. 217484 | ESTs | 15.6 |
| 402855 | | | predicted exon | 15.6 |
| 449635 | AI989942 | Hs. 232150 | ESTs | 15.6 |
| 434392 | AW983709 | Hs. 268051 | ESTs | 15.6 |
| 444301 | AK000136 | Hs. 10760 | hypothetical protein FLJ20129 | 15.6 |
| 414973 | C19089 | | gb: C19089 Human placenta cDNA (TFujiwara) Homo | 15.5 |
| 428374 | AW405156 | Hs. 183994 | protein phosphatase 1, catalytic subunit, alpha isoform | 15.5 |
| 415745 | AI301107 | Hs. 150790 | ESTs | 15.5 |
| 432532 | AW058459 | Hs. 162246 | ESTs | 15.5 |
| 417112 | AA193439 | | gb: zr41b09.s1 Soares_NhHMPu_S1 *Homo sapiens* cDN | 15.5 |
| 418101 | AL047476 | Hs. 98485 | gap junction protein, beta 4 (connexin 30.3) | 15.5 |
| 453110 | AW384928 | Hs. 225160 | *Homo sapiens* cDNA FLJ13102 fis, clone NT2RP3002 | 15.5 |
| 458606 | AJ239397 | | gb: AJ239397 Uni-ZAP XR retinal pigment epithelium H. | 15.5 |
| 436989 | AA741028 | Hs. 256155 | ESTs | 15.5 |
| 407396 | AF011757 | | gb: *Homo sapiens* RAGE binding protein (P12) mRNA, | 15.5 |
| 449684 | AI659166 | Hs. 207144 | ESTs | 15.5 |
| 454666 | AW812994 | | gb: RC3-ST0186-230300-019-g02 ST0186 Homo sapien | 15.5 |
| 430492 | U15197 | Hs. 300803 | Human histo-blood group ABO protein mRNA, partial | 15.5 |
| 439460 | AA836220 | Hs. 13774 | ESTs | 15.5 |
| 449231 | BE410360 | | gb: 601302340F1 NIH_MGC_21 *Homo sapiens* cDNA | 15.5 |
| 453060 | AW294092 | Hs. 21594 | ESTs | 15.5 |
| 416961 | BE391476 | Hs. 80617 | ribosomal protein S16 | 15.5 |
| 439988 | AA860119 | Hs. 255976 | ESTs | 15.5 |
| 400917 | | | predicted exon | 15.5 |
| 424585 | AA464840 | | gb: zx43h11 r1 Soares_total_fetus_Nb2HF8_9w Homo | 15.5 |
| 431029 | BE392725 | Hs. 248571 | *Homo sapiens* PAC clone RP5-1163J12 from 7q21.2–q3 | 15.5 |
| 441680 | AW444598 | Hs. 7940 | RAP1, GTP-GDP dissociation stimulator 1 | 15.5 |
| 437830 | AB020658 | Hs. 5867 | KIAA0851 protein | 15.5 |
| 409479 | BE163800 | Hs. 136912 | ESTs | 15.5 |
| 409885 | AW503068 | | gb: UI-HF-BP0p-aje-g-10-0-UI r1 NIH_MGC_51 Homo | 15.4 |
| 459090 | AA443323 | Hs. 107812 | ESTs, Weakly similar to SPOP [*H. sapiens*] | 15.4 |
| 429324 | AA488101 | Hs. 199245 | inactivation escape 1 | 15.4 |
| 403766 | | | predicted exon | 15.4 |
| 413970 | U59309 | Hs. 75653 | fumarate hydratase | 15.4 |
| 456674 | BE266120 | Hs. 269358 | ESTs | 15.4 |
| 417931 | W95642 | Hs. 82961 | trefoil factor 3 (intestinal) | 15.4 |
| 430125 | U46418 | Hs. 233950 | serine protease inhibitor, Kunitz type 1 | 15.4 |
| 452154 | AW953265 | Hs. 271277 | hypothetical protein from EUROIMAGE 363668 | 15.4 |
| 422984 | W28614 | Hs. 75984 | chorionic somatomammotropin hormone 2 | 15.4 |
| 408649 | BE242232 | Hs. 26045 | protein tyrosine phosphatase, receptor type, A | 15.4 |
| 417497 | AW402482 | Hs. 82212 | CD53 antigen | 15.4 |
| 404666 | | | predicted exon | 15.4 |
| 456847 | AI360456 | Hs. 37776 | ESTs | 15.4 |
| 426995 | AA400646 | Hs. 221988 | ESTs | 15.4 |
| 445350 | AF052112 | Hs. 12540 | lysophospholipase I | 15.4 |
| 450214 | BE439763 | Hs. 227571 | regulator of G-protein signalling 4 | 15.4 |
| 449733 | R74546 | Hs. 29438 | *Homo sapiens* cDNA FLJ12094 fis, clone HEMBB100 | 15.4 |
| 411660 | AW855718 | | gb: RC1-CT0279-070100-021-a06 CT0279 Homo sapie | 15.4 |
| 442653 | BE269247 | Hs. 170226 | *Homo sapiens* clone 23579 mRNA sequence | 15.4 |
| 447552 | AI394125 | Hs. 160413 | ESTs | 15.4 |
| 448712 | W01046 | Hs. 181634 | *Homo sapiens* cDNA FLJ23602 fis, clone LNG15735 | 15.4 |
| 420180 | AI004035 | Hs. 25191 | ESTs | 15.4 |
| 440099 | AL080058 | Hs. 6909 | DKFZP564G202 protein | 15.4 |
| 427550 | BE242818 | Hs. 179606 | nuclear RNA helicase, DECD variant of DEAD box fam | 15.4 |
| 432894 | AW167668 | Hs. 279772 | brain specific protein | 15.3 |
| 412113 | AW161274 | Hs. 74427 | p53-induced protein | 15.3 |
| 431614 | AI189827 | | gb: qd19d07 x1 Soares_placent_8to9weeks_2NbHP8to | 15.3 |
| 445870 | AW410053 | Hs. 13406 | syntaxin 18 | 15.3 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 424347 | AA723883 | Hs. 145513 | *Homo sapiens* mRNA; cDNA DKFZp434L0435 (from | 15.3 |
| 425132 | AW250114 | | gb: 2821134 5prime NIH_MGC_7 *Homo sapiens* cDNA | 15.3 |
| 439756 | AL359651 | Hs. 283852 | *Homo sapiens* mRNA full length insert cDNA close EU | 15.3 |
| 432946 | U60899 | Hs. 279854 | mannosidase, alpha, class 2B, member 1 | 15.3 |
| 406130 | | | predicted exon | 15.3 |
| 453359 | AA448787 | Hs. 24872 | ESTs, Weakly similar to aortic carboxypeptidase-like p | 15.3 |
| 405491 | | | predicted exon | 15.3 |
| 436481 | AA379597 | Hs. 5199 | HSPC150 protein similar to ubiquitin-conjugating enzy | 15.3 |
| 446826 | AK000626 | Hs. 16230 | hypothetical protein FLJ20619 | 15.3 |
| 441211 | AW946155 | Hs. 7750 | hypothetical protein AL133206 | 15.3 |
| 418711 | AW247977 | Hs. 87595 | translocase of inner mitochondrial membrane 22 (yeast) | 15.3 |
| 457301 | AA469146 | | gb: nc67e03 s1 NCl_CGAP_Pr1 *Homo sapiens* cDNA c | 15.3 |
| 449999 | AI679421 | Hs. 231098 | ESTs, Highly similar to ALU4_HUMAN ALU SUBFA | 15.3 |
| 439090 | H65724 | Hs. 271663 | ESTs | 15.3 |
| 416586 | D44643 | Hs. 14144 | secreted modular calcium-binding protein 1 | 15.3 |
| 411940 | AW876686 | | gb: CM4-PT0031-180200-507-e05 PT0031 Homo sapie | 15.3 |
| 407639 | AW205369 | Hs. 252936 | ESTs | 15.3 |
| 458012 | AI424899 | Hs. 188211 | ESTs | 15.3 |
| 426490 | NM_001621 | Hs. 170087 | aryl hydrocarbon receptor | 15.3 |
| 408741 | M73720 | Hs. 646 | carboxypeptidase A3 (mast cell) | 15.3 |
| 437371 | AK000868 | Hs. 5570 | hypothetical protein FLJ10006 | 15.3 |
| 437134 | AA349944 | Hs. 42915 | ARP2 (actin-related protein 2, yeast) homolog | 15.3 |
| 441890 | AI809547 | Hs. 128075 | ESTs | 15.3 |
| 409442 | AA310162 | Hs. 169248 | cytochrome c | 15.3 |
| 407078 | Z26256 | | gb: *H sapiens* isoform 1 gene for L-type calcium channe | 15.2 |
| 436553 | AW407157 | Hs. 181125 | immunoglobulin lambda locus | 15.2 |
| 443177 | BE268461 | Hs. 202 | benzodiazapine receptor (peripheral) | 15.2 |
| 448771 | BE315511 | Hs. 296244 | SNARE protein | 15.2 |
| 436837 | AI968248 | Hs. 187869 | ESTs | 15.2 |
| 423623 | AB011117 | Hs. 129943 | KIAA0545 protein | 15.2 |
| 422651 | NM_015670 | Hs. 118926 | DKFZP586K0919 protein | 15.2 |
| 403221 | AL134878 | Hs. 119500 | karyopherin alpha 4 (importin alpha 3) | 15.2 |
| 431620 | AA126109 | Hs. 264981 | 2'-5'oligoadenylate synthetase 2 | 15.2 |
| 404794 | NM_000078 | Hs. 89538 | cholesteryl ester transfer protein, plasma | 15.2 |
| 412944 | AA384110 | Hs. 197143 | ESTs | 15.2 |
| 450817 | N71597 | Hs. 29698 | ESTs | 15.2 |
| 418666 | AF001434 | Hs. 155119 | EH domain containing 1 | 15.2 |
| 451636 | AW173270 | Hs. 140444 | ESTs | 15.2 |
| 426302 | AA459085 | Hs. 275163 | non-metastatic cells 2, protein (NM23B) expressed in | 15.2 |
| 454485 | AW795322 | | gb: PM0-UM0018-120400-002-h01 UM0018 Homo sap | 15.2 |
| 440617 | AA894880 | Hs. 181181 | ESTs | 15.2 |
| 449718 | AA459480 | Hs. 23956 | hypothetical protein FLJ20502 | 15.2 |
| 405227 | | | predicted exon | 15.2 |
| 431006 | BE152871 | | gb: CM1-HT0333-101299-064-d12 HT0333 Homo sap | 15.2 |
| 443476 | AW068594 | Hs. 133878 | ESTs, Weakly similar to AF151889_1 CGI-131 protein | 15.2 |
| 438828 | AL134275 | Hs. 6434 | hypothetical protein DKFZp761F2014 | 15.2 |
| 407634 | AW016569 | Hs. 301280 | ESTs, Highly similar to AF241831_1 intracellular hyalu | 15.2 |
| 436857 | AA732647 | | gb: nz89d01.s1 NCl_CGAP_GCB1 *Homo sapiens* cDN | 15.2 |
| 431526 | Y10129 | Hs. 258742 | myosin-binding protein C, cardiac | 15.1 |
| 447386 | NM_006289 | Hs. 18420 | KIAA1027 protein | 15.1 |
| 436573 | AA723297 | Hs. 127138 | ESTs | 15.1 |
| 432858 | BE618609 | Hs. 279591 | *Homo sapiens* clone 25056 mRNA sequence | 15.1 |
| 437352 | AL353957 | Hs. 284181 | hypothetical protein DKFZp434P0531 | 15.1 |
| 413209 | AW083791 | Hs. 21263 | *Homo sapiens* cDNA FLJ13152 fis, clone NT2RP3003 | 15.1 |
| 407376 | AA993138 | Hs. 142287 | ESTs, Weakly similar to ALUF_HUMAN !!!! ALU CL | 15.1 |
| 430475 | BE387420 | Hs. 241531 | peflin | 15.1 |
| 446764 | AW291276 | Hs. 285532 | ESTs | 15.1 |
| 425868 | AB017548 | Hs. 160100 | *Homo sapiens* gene for Sepiapterin Reductase, partial c | 15.1 |
| 453464 | AI884911 | Hs. 32989 | receptor (calcitonin) activity modifying protein 1 | 15.1 |
| 447246 | AW449032 | Hs. 170257 | ESTs | 15.1 |
| 401780 | | | predicted exon | 15.1 |
| 434063 | AA018893 | Hs. 3727 | unr-interacting protein | 15.1 |
| 416114 | AI695549 | Hs. 183868 | glucuronidase, beta | 15.1 |
| 441018 | AI809587 | Hs. 148782 | ESTs | 15.1 |
| 425972 | BE391563 | Hs. 165433 | ESTs, Highly similar to T17342 hypothetical protein D | 15.1 |
| 426062 | N57014 | Hs. 44013 | ESTs | 15.1 |
| 451234 | AI914901 | Hs. 24052 | ESTs | 15.1 |
| 429565 | AB020719 | Hs. 207802 | KIAA0912 protein | 15.1 |
| 418092 | R45154 | Hs. 106604 | ESTs | 15.1 |
| 424550 | AI650541 | Hs. 115298 | ESTs | 15.1 |
| 425023 | AW956889 | Hs. 154210 | endothelial differentiation, sphingolipid G-protein-coup | 15.1 |
| 445213 | AW204314 | Hs. 170784 | ESTs | 15.1 |
| 418102 | R58958 | Hs. 26608 | ESTs | 15.0 |
| 450082 | AI908894 | Hs. 245893 | ESTs | 15.0 |
| 446749 | NM_016069 | Hs. 16089 | CGI-136 protein | 15.0 |

TABLE 3A-continued

ABOUT 1643 UP-REGULATED GENES, OVARIAN CANCER VERSUS NORMAL OVARY

| Pkey | Ex Accn No. | UG ID | Title | ratio |
|---|---|---|---|---|
| 406124 | | | predicted exon | 15.0 |
| 457408 | AL137507 | Hs. 255348 | Homo sapiens mRNA; cDNA DKFZp761P211 (from c | 15.0 |
| 410051 | U25773 | Hs. 218182 | ESTs, Weakly similar to dJ1042K10 2 [H. sapiens] | 15.0 |
| 440965 | AI523646 | Hs. 169859 | ESTs | 15.0 |
| 440190 | AW752597 | | gb: IL3-CT0214-161299-045-B06 CT0214 Homo sapien | 15.0 |
| 417437 | U52682 | Hs. 82132 | interferon regulatory factor 4 | 15.0 |
| 454249 | AW249008 | | gb: 2821048 5prime NIH_MGC_7 Homo sapiens cDNA | 15.0 |
| 432276 | AF163302 | Hs. 274255 | somatostatin receptor-interacting protein | 15.0 |
| 401116 | | | predicted exon | 15.0 |
| 423960 | AA164516 | Hs. 136309 | CGI-61 protein | 15.0 |
| 451661 | AB020650 | Hs. 26777 | KIAA0843 protein | 15.0 |
| 450983 | AA305384 | Hs. 25740 | ERO1 (S. cerevisiae)-like | 15.0 |
| 446187 | AK001241 | Hs. 14229 | hypothetical protein FLJ10379 | 15.0 |
| 404122 | | | predicted exon | 15.0 |
| 411299 | BE409857 | Hs. 69499 | hypothetical protein | 15.0 |
| 403077 | | | predicted exon | 15.0 |
| 438000 | AI825880 | Hs. 5985 | non-kinase Cdc42 effector protein SPEC2 | 15.0 |
| 447118 | AB014599 | Hs. 17411 | KIAA0699 protein | 15.0 |
| 417878 | U90916 | Hs. 82845 | Human clone 23815 mRNA sequence | 15.0 |
| 444079 | H09048 | Hs. 23606 | ESTs | 15.0 |
| 458234 | BE551408 | Hs. 127196 | ESTs | 15.0 |
| 434208 | T92641 | Hs. 127648 | hypothetical protein PRO2176 | 15.0 |
| 423136 | AW375506 | Hs. 124147 | ESTs | 15.0 |
| 403177 | | | predicted exon | 15.0 |
| 448699 | AI857269 | Hs. 227351 | ESTs | 15.0 |
| 425248 | AW957442 | Hs. 252766 | ESTs | 15.0 |
| 429430 | AI381837 | Hs. 155335 | ESTs | 15.0 |

Pkey: Primekey
Ex Accn: Exemplar Accession
UG ID: UniGene ID
Title: Unigene Title
PFAM: domains
ratio: tumor vs. normal tissues

TABLE 3B

| Pkey | CAT Number | Accession |
|---|---|---|
| 408310 | 1051011_1 | AW179023 AW179010 |
| 408647 | 1071855_1 | AW245831 AW273207 |
| 408661 | 1073036_1 | AW247625 AW249214 |
| 408987 | 109306_1 | H85615 H86300 H86263 H86282 AA059278 H86304 |
| 409427 | 1129667_1 | AW389668 AW389657 AW609198 AW389649 |
| 409545 | 1138823_1 | BE296182 AW629821 |
| 409828 | 1155571_1 | AW501137 AW501295 AW501212 |
| 409865 | 1156518_1 | AW502208 AW502366 AW502148 |
| 409885 | 1157385_1 | AW503068 AW503789 |
| 410003 | 116761_1 | AA079487 AA128547 AA128291 AA079587 AA079600 |
| 410186 | 1182096_1 | AW602528 BE073859 Z38412 |
| 410626 | 1212621_−1 | BE407727 |
| 411004 | 1228975_1 | AW813242 BE146089 AW813195 AW813173 AW813206 BE145953 BE146212 AW813196 AW854582 AW813241 BE061582 |
| 411014 | 1229091_1 | AW816072 AW813375 AW813385 AW813372 AW813436 AW816148 AW813475 AW816107 AW813398 AW813479 AW814475 AW813317 |
| 411028 | 1229404_1 | AW813703 AW813839 |
| 411236 | 1236374_1 | AW833752 AW833633 AW833776 AW833719 AW833362 AW833749 |
| 411420 | 1245222_−1 | BE390652 |
| 411541 | 1249044_1 | W03940 T98335 AW850705 |
| 411551 | 1249196_1 | AW851309 AW850888 AW851419 AW851412 AW851299 |
| 411651 | 1252835_1 | AW855392 AW855559 AW855423 |
| 411660 | 1253078_1 | AW855718 AW855740 AW855748 |
| 411696 | 1254304_1 | AW857404 AW857401 BE144856 |
| 411811 | 1259427_1 | AW864370 AW864319 AW864504 |
| 411930 | 1266070_1 | F06485 AW876454 |
| 411940 | 1266262_1 | AW876686 AW876717 AW877215 AW876691 AW876722 AW877218 AW876694 AW876725 |
| 411942 | 1266449_1 | AW877015 AW877133 AW876978 AW877071 AW876988 AW877069 AW877063 AW877013 |
| 412793 | 1327636_−1 | AW997986 |
| 413047 | 1346806_1 | H02209 BE062154 BE062032 |
| 413101 | 1349154_1 | BE065215 BE155544 BE155541 BE155540 BE155542 BE155543 |
| 413154 | 1351077_1 | BE067870 BE067866 BE165133 BE165334 BE165329 BE165332 |
| 413282 | 1358147_1 | BE078159 BE078276 BE078163 BE078277 BE078279 BE078158 |
| 413442 | 1370508_1 | BE140643 BE140645 BE140644 BE140657 BE140660 BE140659 BE140661 |

TABLE 3B-continued

| Pkey | CAT Number | Accession |
|---|---|---|
| 413544 | 1375671__1 | BE147225 BE147205 BE147234 |
| 413605 | 1379792__1 | BE152644 BE152712 BE152668 BE152659 BE152810 BE152811 BE152816 BE152643 BE152706 BE152656 BE152660 BE152715 BE152662 BE152669 BE152661 BE152672 BE152653 BE152716 BE152651 BE152767 BE152677 BE152652 BE152714 BE152708 BE152665 BE152679 BE152771 BE152775 BE152666 BE152768 BE152813 BE152664 BE152676 BE152681 BE152709 BE152667 BE152814 BE152808 BE152711 BE152707 BE152815 8E152678 BE152673 BE152782 BE152671 BE152682 BE152760 BE152809 BE152778 BE152780 BE152762 BE152776 BE152781 BE152774 BE152763 BE152769 |
| 413679 | 1382784__1 | BE156765 BE156770 BE156767 BE156769 BE156803 BE156802 BE156847 BE156853 BE156780 BE156836 BE156792 BE156834 BE156779 BE156789 BE156833 BE156844 BE156831 BE156849 BE156797 BE156784 BE156801 BE156843 BE156793 BE156852 |
| 413758 | 1386900__-1 | BE162391 |
| 414070 | 141442__1 | AW963783 F36521 F30667 AW753177 AW753195 AW853065 AA135150 AA375028 |
| 414195 | 1424854__-3 | BE263293 |
| 414203 | 1425510__2 | BE262170 BE382553 BE261026 BE273627 |
| 414266 | 1430984__1 | BE267834 BE514180 BE514096 |
| 414276 | 1432115__-1 | BE297862 |
| 414333 | 1436492__1 | BE274897 BE408199 BE274723 |
| 414444 | 1446827__-1 | BE298594 |
| 414539 | 1460320__1 | BE379046 BE395459 |
| 414540 | 1460324__-1 | BE379050 |
| 414605 | 1465790__-1 | BE390440 |
| 414610 | 1466027__1 | BE388044 BE391117 BE391530 |
| 414626 | 1467232__1 | BE410589 BE390949 BE408297 BE389529 |
| 414642 | 146960__1 | AA150350 AA361174 AW959038 |
| 414663 | 1472628__-1 | BE396326 |
| 414973 | 1510755__1 | C19089 C18814 C16621 |
| 415160 | 1525766__1 | T82802 D78670 R08505 |
| 415606 | 1540470__1 | W70022 R35201 F12763 T74725 H63485 Z45782 H61126 |
| 415917 | 1561575__1 | Z43912 H09194 |
| 416272 | 158407__1 | AA178882 AA179898 AA178897 |
| 416475 | 1596398__1 | T70298 H58072 R02750 |
| 416913 | 163001__1 | AW934714 BE161007 BE162500 AW749902 AW749864 BE162498 BE161005 AA190449 AW513466 BE161006 BE162499 |
| 417112 | 165068__1 | AA193439 AA193537 AW814128 |
| 417611 | 168900__1 | AW993983 AW994798 AW993990 AW993999 AW993989 AA204755 |
| 417908 | 170764__1 | AA207221 BE538271 |
| 418636 | 177402__1 | AW749855 AA225995 AW750208 AW750206 |
| 418874 | 1799516__1 | T60872 T60906 |
| 419618 | 186533__1 | AA528295 AW971284 AA247945 |
| 419889 | 188798__1 | AA251600 AA279607 |
| 420902 | 197525__1 | AA742277 AW976493 AA281585 |
| 422160 | 212412__1 | AW582898 AA305114 |
| 422731 | 220507__1 | AL138411 AL138412 AA315860 |
| 422831 | 221879__1 | R02504 AA317715 AW961465 AF121172 |
| 423050 | 224288__1 | AA320946 H92114 BE144449 BE144438 |
| 423103 | 225019__1 | AA322029 BE315237 |
| 423287 | 226793__1 | H38340 H39081 AA324112 |
| 423621 | 230314__1 | BE002904 H64880 AA328679 |
| 424585 | 241151__1 | AA464840 AA343628 |
| 424995 | 245794__1 | Z45023 AA349514 |
| 425132 | 247059__1 | AW250114 Z43124 AA431421 AI879054 AA351616 AA351035 AL048999 |
| 425612 | 253969__1 | BE004257 AW811190 AA360576 BE172402 BE181703 |
| 425798 | 256586__1 | AA364002 AI522307 |
| 426065 | 260276__1 | N32049 R34821 R78237 |
| 426356 | 265381__1 | BE536836 AA376153 |
| 426383 | 266126__1 | BE537380 BE255215 |
| 428151 | 287658__1 | AA422028 W79191 |
| 431006 | 326833__1 | BE152871 BE152870 AA490552 |
| 431257 | 33049__1 | AF039597 BE243938 |
| 431614 | 335668__1 | AI189827 AW860554 AW860552 AA508543 |
| 431822 | 338082__1 | AA516049 AW004922 |
| 432966 | 356839__1 | AA650114 AW974148 AA572946 |
| 433300 | 362452__1 | AA582307 BE273018 |
| 433355 | 364004__1 | AI808235 AI024295 AA584528 |
| 433459 | 366899__1 | AA593498 AW749647 AW749630 |
| 433469 | 367263__1 | F12741 T75155 AA594014 |
| 433782 | 37414__1 | AF090945 AW996754 AI064870 |
| 434098 | 380006__1 | AA625499 AA625269 AA625184 |
| 435138 | 401159__1 | BE314734 AA666393 |
| 435478 | 406683__1 | AA682622 BE141696 |
| 436857 | 428068__1 | AA732647 BE008970 BE009028 |
| 439078 | 46841__1 | AF085936 H64070 H64017 |
| 439465 | 47272__1 | AF086285 W69587 W69421 |
| 439848 | 477806__1 | AW979249 D63277 AA846968 |
| 440190 | 488021__1 | AW752597 AW848781 AW849062 AW848490 AW752699 AW752604 AW752700 |
| 440669 | 499861__1 | AI206964 AI350890 AA902772 AI768881 |

TABLE 3B-continued

| Pkey | CAT Number | Accession |
|---|---|---|
| 441552 | 520138_1 | AA937975 F11215 BE005635 |
| 442257 | 53699_1 | AW503831 AW503317 BE565665 |
| 443198 | 562655_1 | AI039813 AI684642 Z40121 AI951414 BE501049 |
| 443534 | 572957_1 | AI076123 AI244834 AI695239 |
| 446052 | 65988_1 | AA358760 AA158850 AW062737 AW062738 AV656291 |
| 446598 | 68463_1 | AW250546 BE257108 BE251006 BE255957 BE250926 BE513012 AV659318 |
| 447224 | 71279__-1 | BE617125 |
| 447252 | 714160_1 | R90916 AL120023 R18429 Z42095 AI369730 R90824 |
| 447383 | 71990_1 | N24231 BE617964 N36313 |
| 447775 | 73665_1 | BE179318 BE620044 |
| 447787 | 73719_1 | BE620108 BE312062 AW896316 BE262546 |
| 448218 | 75525_1 | AI188489 BE622201 |
| 448338 | 758968_1 | AI492857 AW070478 AI885157 |
| 448838 | 78409_4 | BE614761 AA263136 W00335 W00327 |
| 449231 | 80303_1 | BE410360 AA442408 AA315540 |
| 450594 | 83962_1 | N31036 N42915 F07753 AA010329 |
| 451400 | 868459_1 | BE160479 BE160478 BE069211 AW861059 AI793147 |
| 452544 | 921467_1 | AW851888 AW851889 AW852147 |
| 452947 | 939810_1 | AW130413 AI932362 |
| 453758 | 980026_1 | U83527 AL120938 U83522 |
| 454163 | 1048369_1 | AW175997 AW176000 AW175999 AW175994 AW176004 AW175989 |
| 454178 | 1049458_1 | AW177274 AW177249 AW177223 AW177216 AW177233 |
| 454181 | 1049567_1 | AW177377 AW177357 AW177359 AW177385 AW177358 AW177395 AW177394 AW177396 AW177383 AW177333 AW177384 AW177382 AW177360 AW177356 |
| 454209 | 1051071_1 | AW179083 AW179085 AW179087 AW179081 AW179084 AW179086 AW179082 AW801493 AW801658 AW801714 |
| 454249 | 1073933_1 | AW249008 BE295653 BE296765 |
| 454377 | 114761_1 | AA076811 AW814764 |
| 454478 | 1214744_1 | AW805749 AW805872 AW794466 AW798102 AW796921 AW794538 AW794380 |
| 454485 | 1215381_1 | AW795322 AW795308 AW795311 AW795310 AW795314 AW795321 |
| 454505 | 1219564_1 | AW801365 AW801435 AW801372 |
| 454574 | 1225636_1 | AW809109 AW809112 AW809122 AW809126 AW809128 AW809133 AW809131 AW809113 AW809111 AW809132 |
| 454610 | 1226543_1 | AW810224 AW810337 AW810295 AW810333 AW810335 AW810296 AW816053 |
| 454633 | 1227504_1 | AW811380 AW811385 |
| 454666 | 1228600_1 | AW812994 AW812723 AW812930 |
| 454803 | 1235520_1 | AW860148 AW862380 AW821887 AW821863 AW821870 AW821894 AW862351 AW862378 |
| 454961 | 1246745_1 | AW847807 AW847935 AW847636 |
| 455132 | 1254686_1 | AW857955 AW861636 AW857967 AW857958 AW857943 AW857945 AW857963 AW857968 AW857959 AW857961 AW857956 BE072135 AW857972 BE072137 AW857952 AW857935 AW857940 AW857944 AW857947 AW857934 |
| 455426 | 1289303_1 | AW937792 BE072250 BE072251 BE072264 |
| 455640 | 1348141_1 | BE064059 BE063903 BE063838 BE063863 BE064056 BE063974 BE063904 BE063898 BE063896 BE063906 BE063980 |
| 455694 | 1350650_1 | BE067300 BE067293 BE067279 |
| 455910 | 1382504_1 | Z43712 BE156729 BE156538 BE156731 BE156673 BE156539 BE156674 BE156430 BE156672 BE156675 BE156432 BE156541 |
| 455993 | 1398665_1 | BE179085 BE179084 BE179086 BE179264 |
| 456054 | 1452761_1 | BE313241 BE383148 |
| 456329 | 1789807_1 | T41418 T41320 T41379 |
| 456394 | 1843275__-2 | W28506 |
| 457301 | 314434_1 | AA469146 AA469396 AA469218 AA469395 |
| 458025 | 46409_1 | AI275406 L23206 |
| 458606 | 65568_1 | AJ239397 AV655764 |
| 458640 | 670076_1 | AI284935 AW409822 BE408182 |
| 458710 | 69727_1 | AV660856 BE167375 |
| 458792 | 748294_1 | N56666 AI460076 |
| 459170 | 920646_1 | AI905518 AI905516 AI905457 AI905515 AW176013 AW176037 |
| 459270 | 969232_1 | AL039604 AL039497 |

Pkey: Unique Eos probeset identifier number
CAT number Gene cluster number
Accession: Genbank accession numbers

TABLE 3C

| Pkey | Ref | Strand | Nt_position |
|---|---|---|---|
| 400449 | 9887692 | Minus | 50889–51188 |
| 400613 | 9864507 | Plus | 92278–92472 |
| 400634 | 8567750 | Minus | 101102–101223, 101886–102018 |
| 400642 | 8117693 | Plus | 10475–10845 |
| 400661 | 8118474 | Plus | 84912–85187 |
| 400684 | 8118768 | Plus | 58189–58323 |
| 400685 | 8118768 | Minus | 72969–73050, 73713–73800 |

TABLE 3C-continued

| Pkey | Ref | Strand | Nt_position |
|---|---|---|---|
| 400727 | 6705887 | Plus | 106175–107016 |
| 400749 | 7331445 | Minus | 9162–9293 |
| 400807 | 8567878 | Plus | 69375–70295 |
| 400837 | 9188531 | Plus | 144778–144838, 145582–145670, 146656–146751, 147255–147419, 147682–147807 |
| 400842 | 1927148 | Plus | 90462–90673 |
| 400848 | 1927148 | Plus | 107149–107339, 110873–111171 |
| 400891 | 9958279 | Minus | 140073–140427 |
| 400917 | 7283186 | Minus | 173258–173631 |
| 400931 | 7651921 | Minus | 142145–142353, 144311–144721 |
| 400964 | 7139719 | Minus | 155282–155403 |
| 400965 | 7770576 | Minus | 173043–173564 |
| 400970 | 7960452 | Minus | 92744–92895 |
| 400982 | 8078794 | Minus | 119245–119471 |
| 401010 | 8117391 | Minus | 83967–84180 |
| 401072 | 3687273 | Plus | 64370–64524 |
| 401088 | 8492704 | Plus | 194659–195179 |
| 401116 | 9966559 | Plus | 123579–124447 |
| 401117 | 8570083 | Minus | 28948–29204 |
| 401167 | 9438381 | Plus | 18944–19176 |
| 401204 | 9743388 | Minus | 33694–33872 |
| 401220 | 9929324 | Minus | 48079–48279 |
| 401244 | 4827300 | Minus | 55359–56376 |
| 401245 | 4827300 | Minus | 59373–59531 |
| 401268 | 9797154 | Plus | 152272–152483, 157312–157418, 158025–158205, 158838–158974, 160716–160952 |
| 401269 | 8954206 | Plus | 2259–2591 |
| 401283 | 9800093 | Minus | 47256–47456 |
| 401373 | 7248205 | Minus | 84211–84336 |
| 401405 | 7768126 | Minus | 69276–69452, 69548–69958 |
| 401465 | 6682292 | Plus | 25676–25800 |
| 401492 | 7341778 | Plus | 171020–171282, 171858–172241 |
| 401521 | 7705251 | Plus | 9127–9234 |
| 401566 | 8469090 | Minus | 96277–96420, 96979–97160 |
| 401575 | 7229804 | Minus | 76253–76364 |
| 401589 | 9966292 | Plus | 135969–136263 |
| 401628 | 8575954 | Minus | 210617–210796 |
| 401657 | 9100664 | Minus | 7312–8163 |
| 401747 | 9789672 | Minus | 118596–118816, 119119–119244, 119609–119761, 120422–120990, 130161–130381, 130468–130593, 131097–131258, 131866–131932, 132451–132575, 133580–134011 |
| 401757 | 7239630 | Plus | 88641–88751 |
| 401780 | 7249190 | Minus | 28397–28617, 28920–29045, 29135–29296, 29411–29567, 29705–29787, 30224–30573 |
| 401781 | 7249190 | Minus | 83215–83435, 83531–83656, 83740–83901, 84237–84393, 84955–85037, 86290–86814 |
| 401785 | 7249190 | Minus | 165776–165996, 166189–166314, 166408–166569, 167112–167268, 167387–167469, 168634–168942 |
| 401789 | 7249213 | Minus | 70399–70629, 70941–71055 |
| 401809 | 7342191 | Minus | 107548–108298 |
| 401847 | 7139731 | Plus | 85447–85593 |
| 401887 | 7229981 | Plus | 93973–94120 |
| 401913 | 9369520 | Minus | 33753–33904 |
| 401962 | 3176728 | Minus | 71433–71648, 76711–76833, 78677–78845, 79585–79763, 82349–82485 |
| 401991 | 4156128 | Plus | 2398–2513 |
| 401994 | 4153858 | Minus | 42904–43124, 43211–43336, 44607–44763, 45199–45281, 46337–46732 |
| 402023 | 7528158 | Minus | 132872–133040 |
| 402066 | 6649269 | Plus | 135543–136031 |
| 402071 | 8117361 | Plus | 85924–86039 |
| 402075 | 8117407 | Plus | 121907–122035, 122804–122921, 124019–124161, 124455–124610, 125672–126076 |
| 402131 | 7704961 | Minus | 33114–33209, 33496–33678 |
| 402144 | 7242326 | Plus | 115425–115977 |
| 402203 | 8576119 | Minus | 8124–8285 |
| 402277 | 2894631 | Plus | 16980–17152, 17933–18018, 18170–18306 |
| 402292 | 2447220 | Plus | 33880–34029, 34176–34336, 34953–35103 |
| 402297 | 6598824 | Plus | 35279–35405, 35573–35659 |
| 402407 | 3962498 | Minus | 115812–116187 |
| 402421 | 9796341 | Minus | 46609–46662, 46758–46811, 86293–86346, 89776–89829, 90048–90101, 102817–102924 |
| 402427 | 9796372 | Plus | 16266–16431 |
| 402430 | 9796372 | Minus | 62382–62552 |
| 402520 | 7596899 | Minus | 171761–171996 |
| 402538 | 9801137 | Minus | 96314–96539 |
| 402543 | 9838066 | Minus | 89684–90893 |
| 402570 | 9884747 | Minus | 12649–12866 |
| 402585 | 9908890 | Minus | 174893–175050, 183210–183435 |
| 402639 | 9958129 | Minus | 20167–22383 |
| 402694 | 8569867 | Plus | 2218–2440 |
| 402699 | 8570304 | Minus | 182773–182883, 184551–184732 |
| 402738 | 7331557 | Minus | 8725–8859 |
| 402855 | 9662953 | Minus | 59763–59909 |
| 402869 | 6434643 | Minus | 138639–139335 |
| 402939 | 9187334 | Minus | 18329–18535 |

TABLE 3C-continued

| Pkey | Ref | Strand | Nt_position |
|---|---|---|---|
| 402944 | 9368423 | Plus | 110411–110716, 111173–111640 |
| 402948 | 9368458 | Minus | 143456–143626, 143808–143935 |
| 402958 | 9368493 | Plus | 13324–13507 |
| 403010 | 3132346 | Plus | 78385–79052 |
| 403036 | 3132360 | Plus | 66545–66712 |
| 403051 | 4827080 | Minus | 5269–5411 |
| 403065 | 8954197 | Minus | 71615–71773, 73930–74144 |
| 403077 | 8954241 | Plus | 146923–147222, 147326–147628 |
| 403093 | 8954241 | Plus | 177083–177373, 177464–177751 |
| 403151 | 7407965 | Minus | 14055–14264 |
| 403153 | 9799871 | Minus | 42232–43389 |
| 403177 | 9838213 | Minus | 142560–142726 |
| 403223 | 7630969 | Plus | 81529–81692 |
| 403234 | 7637801 | Plus | 180641–180822 |
| 403273 | 8018055 | Plus | 133809–134099 |
| 403286 | 8080320 | Plus | 118369–118872 |
| 403287 | 8080320 | Minus | 126097–126411 |
| 403348 | 7239527 | Plus | 13809–13968 |
| 403359 | 8570207 | Minus | 108939–109229 |
| 403362 | 8571772 | Plus | 64099–64260 |
| 403447 | 9837821 | Minus | 159072–159387 |
| 403508 | 7630896 | Plus | 5570–5719 |
| 403582 | 8101186 | Plus | 18308–18458 |
| 403613 | 8493504 | Plus | 81290–81465 |
| 403642 | 8699671 | Plus | 7062–7311 |
| 403662 | 5823349 | Plus | 58627–59062, 59222–59548 |
| 403674 | 7321642 | Plus | 104988–105623, 107394–107590 |
| 403687 | 7387384 | Plus | 9009–9534 |
| 403695 | 3046276 | Plus | 168272–168514 |
| 403703 | 4966380 | Plus | 83681–84042 |
| 403741 | 7630932 | Minus | 2833–3468 |
| 403747 | 7658395 | Minus | 20493–20621 |
| 403766 | 7229888 | Plus | 136283–136830 |
| 403786 | 8083636 | Minus | 73028–73217 |
| 403796 | 8099896 | Minus | 75073–77664 |
| 403833 | 887461 | Plus | 13522–13664 |
| 403852 | 7708872 | Minus | 124007–124202 |
| 403861 | 7708966 | Plus | 58363–58649 |
| 403912 | 7710730 | Minus | 72000–72290, 72431–72700, 72929–73199 |
| 403924 | 7711688 | Minus | 89369–89592 |
| 403964 | 7596976 | Plus | 178174–178300 |
| 404034 | 8567760 | Minus | 44635–47010 |
| 404067 | 3282162 | Plus | 1415–2071 |
| 404097 | 7770701 | Plus | 55512–55781 |
| 404122 | 9796270 | Plus | 90540–92977 |
| 404230 | 7981448 | Minus | 92934–93093 |
| 404239 | 5002624 | Plus | 94841–95095 |
| 404240 | 5002624 | Minus | 116132–116407, 116653–116922 |
| 404270 | 9828129 | Minus | 3649–3750, 4161–4306, 5962–6049, 6849–6965 |
| 404356 | 7630858 | Minus | 126433–126623 |
| 404600 | 8705107 | Plus | 118354–118444, 118649–118792 |
| 404601 | 8705107 | Plus | 128449–128693, 129085–129249, 130525–130733 |
| 404638 | 9796751 | Minus | 99433–99528, 100035–100161 |
| 404666 | 7272179 | Minus | 18677–18993 |
| 404675 | 9797204 | Minus | 48532–48645, 49808–49975, 51088–51369, 54944–55063 |
| 404727 | 8081050 | Plus | 115534–115747 |
| 404750 | 7596836 | Plus | 181879–182198 |
| 404763 | 7882612 | Plus | 50981–51392 |
| 404767 | 7882827 | Minus | 23244–23759 |
| 404828 | 6580415 | Minus | 26291–27253 |
| 404850 | 5420148 | Minus | 35145–35413, 40635–41062 |
| 404881 | 5931510 | Minus | 36360–36608 |
| 404890 | 7329390 | Plus | 101280–101408 |
| 404971 | 3212939 | Minus | 74585–75532 |
| 405022 | 7330304 | Plus | 217163–217439 |
| 405028 | 7533974 | Minus | 110588–110847, 110933–111115 |
| 405071 | 7708797 | Minus | 11115–11552 |
| 405088 | 8072518 | Minus | 115690–117621 |
| 405133 | 8516055 | Minus | 28127–28288 |
| 405138 | 8576241 | Plus | 90303–90516 |
| 405183 | 7209940 | Plus | 12335–12653 |
| 405194 | 7230072 | Plus | 190465–190645, 193346–193610 |
| 405196 | 7230083 | Minus | 135716–135851 |
| 405208 | 7230142 | Plus | 8068–8214 |
| 405226 | 7248966 | Plus | 53547–54128 |
| 405227 | 6731245 | Minus | 22550–22802 |
| 405256 | 7329310 | Plus | 26070–26309 |

TABLE 3C-continued

| Pkey | Ref | Strand | Nt_position |
|---|---|---|---|
| 405277 | 3980473 | Plus | 23471–23572 |
| 405307 | 3638954 | Plus | 39195–39429 |
| 405311 | 3638954 | Plus | 46313–46496 |
| 405333 | 3165399 | Plus | 149905–150215 |
| 405411 | 3451356 | Minus | 17503–17778, 18021–18290 |
| 405423 | 4753276 | Plus | 6162–6983 |
| 405491 | 5801645 | Plus | 81857–82045 |
| 405501 | 9211311 | Minus | 49085–49400, 49565–49679, 50117–50262 |
| 405515 | 9454624 | Plus | 37329–37469 |
| 405545 | 1054740 | Plus | 118677–118807, 119091–119296, 121626–121823 |
| 405580 | 4512267 | Plus | 169232–169647 |
| 405586 | 5002511 | Plus | 38810–39017 |
| 405600 | 5923640 | Plus | 26662–27225 |
| 405610 | 5757553 | Minus | 71907–72080 |
| 405639 | 5091650 | Plus | 211184–211350 |
| 405687 | 6249668 | Minus | 54787–54891, 55844–55917 |
| 405699 | 4165331 | Plus | 100727–100859 |
| 405783 | 5738434 | Minus | 27238–27885 |
| 405867 | 6758731 | Minus | 74553–75173 |
| 406086 | 7107817 | Plus | 9418–9573 |
| 406124 | 9149714 | Minus | 1331–1774 |
| 406130 | 9161404 | Minus | 32394–32498 |
| 406140 | 9168231 | Minus | 49887–50219 |
| 406160 | 7144945 | Plus | 55498–56268 |
| 406207 | 5923650 | Minus | 162607–162800 |
| 406215 | 7342161 | Plus | 310–432 |
| 406268 | 6682695 | Minus | 6605–7072 |
| 406277 | 5686030 | Minus | 4759–5490 |
| 406326 | 9212385 | Plus | 84508–84655 |
| 406388 | 9256205 | Plus | 85153–85277 |
| 406457 | 9755793 | Plus | 44966–45406 |
| 406473 | 9795566 | Minus | 109669–109931 |
| 406537 | 7711478 | Plus | 32904–33017 |
| 406571 | 7711622 | Minus | 65634–65912, 66116–66596 |
| 406580 | 7711838 | Minus | 96654–97640 |

Pkey Unique number corresponding to an Eos probeset
Ref Sequence source The 7 digit numbers in this column are Genbank Identifier (GI) numbers, "Dunham I et al." refers to the publication entitled "The DNA sequence of human chromosome 22" Dunham, et al. (1999) Nature 402: 489–495
Strand: Indicates DNA strand from which exons were predicted
Nt_position Indicates nucleotide positions of predicted exons TABLE 4A lists about 131 genes up-regulated in ovarian cancer compared to normal ovaries that are likely to be extracellular or cell-surface proteins These were selected for Table 3A, except that the ratio was greater than or equal to 10, and the predicted protein contained a PFAM domain that is indicitive of extracellular localization

TABLE 4A

ABOUT131 UP-REGULATED GENES ENCODING EXTRACELLULAR/CELL SURFACE PROTEINS, OVARIAN CANCER VERSUS NORMAL OVARY

| Pkey | Ex. Accn | UG ID | Title | PFAM | ratio |
|---|---|---|---|---|---|
| 403077 | | | predicted exon | fn3 | 15.0 |
| 426535 | AU077012 | Hs. 288582 | ESTs, Weakly similar to ubiquitous TP | Kunitz_BPTI | 14.9 |
| 403089 | | | predicted exon | fn3 | 14.9 |
| 457148 | AF091035 | Hs. 184627 | KIAA0118 protein | arf; ras | 14.8 |
| 431176 | AI026984 | Hs. 293662 | ESTs | laminin_EGF; laminin_B, | 14.8 |
| 434293 | NM_004445 | Hs. 3796 | EphB6 | fn3, pkinase, EPH_lbd | 14.8 |
| 408482 | NM_000676 | Hs. 45743 | adenosine A2b receptor | 7tm_1 | 14.6 |
| 428695 | AI355647 | Hs. 189999 | punnergic receptor (family A group 5) | 7tm_1 | 14.5 |
| 426125 | X87241 | Hs. 166994 | FAT tumor suppressor (Drosophila) ho | EGF | 14.4 |
| 423732 | AF058056 | Hs. 132183 | solute carrier family 16 (monocarboxy | sugar_tr, MCT | 14.3 |
| 422125 | NM_003459 | Hs. 111967 | solute carrier family 30 (zinc transporte | Cation_efflux | 14.2 |
| 407483 | NM_012368 | | (NONE) | 7tm_1 | 14.2 |
| 446689 | AW594695 | Hs. 167046 | ESTs | 7tm_1 | 14.1 |
| 410184 | AW503667 | Hs. 59545 | ring finger protein 15 | zf-C3HC4; SPRY, zf-B_box | 14.0 |
| 423217 | NM_000094 | Hs. 1640 | collagen, type VII, alpha 1 (epidermoly | fn3, vwa | 14.0 |
| 405448 | AI015709 | Hs. 172089 | Homo sapiens mRNA, cDNA DKFZp5 | trypsin, sushi, CUB | 14.0 |
| 450684 | AA872605 | Hs. 25333 | interleukin 1 receptor, type II | ig | 14.0 |
| 406692 | L36607 | | gb: Homo sapiens (clone 22) pregnancy | ig | 13.9 |
| 425549 | U64863 | Hs. 158297 | programmed cell death 1 | ig | 13.8 |
| 452755 | AW138937 | Hs. 213436 | ESTs | cystatin | 13.8 |
| 427637 | AK000816 | Hs. 179986 | flotillin 1 | Band_7 | 13.7 |

TABLE 4A-continued

ABOUT 131 UP-REGULATED GENES ENCODING EXTRACELLULAR/CELL SURFACE PROTEINS, OVARIAN CANCER VERSUS NORMAL OVARY

| Pkey | Ex. Accn | UG ID | Title | PFAM | ratio |
|---|---|---|---|---|---|
| 424591 | R55704 | Hs. 150968 | hypocretin (orexin) receptor 1 | 7tm_1 | 13.7 |
| 405024 | | | predicted exon | TGF-beta, TGFb_propeptide | 13.7 |
| 405285 | | | predicted exon | A2M, A2M_N | 13.7 |
| 412116 | AW402166 | Hs. 784 | Epstein-Barr virus induced gene 2 (lym | 7tm_1 | 13.7 |
| 420256 | U84722 | Hs. 76206 | cadherin 5, type 2, VE-cadherin (vascu | cadherin, Cadherin_C_term | 13.6 |
| 420511 | AF052692 | Hs. 98485 | gap junction protein, beta 4 (connexin 3 | connexin | 13.5 |
| 448638 | R17122 | Hs. 21639 | nuclear protein, marker for differentiat | ig | 13.4 |
| 431117 | AF003522 | Hs. 250500 | delta (Drosophila)-like 1 | EGF, DSL | 13.4 |
| 439285 | AL133916 | Hs. 298998 | ESTs | ig, pkinase, LRRNT, LRRCT | 13.4 |
| 424283 | AA338246 | Hs. 301678 | ESTs | E1-E2_ATPase, Hydrolase | 13.3 |
| 436233 | AI742878 | Hs. 124116 | ESTs | ig | 13.3 |
| 443859 | NM_013409 | Hs. 9914 | follistatin | kazal | 13.2 |
| 410016 | AA297977 | Hs. 57907 | small inducible cytokine subfamily A ( | IL8 | 13.2 |
| 414020 | NM_002984 | Hs. 75703 | small inducible cytokine A4 (homologo | IL8 | 13.2 |
| 400242 | | | predicted exon | Ephrin | 13.0 |
| 429057 | AF156557 | Hs. 194816 | stomatin-like protein 1 | Band_7, SCP2 | 12.9 |
| 438294 | AI693753 | Hs. 143004 | ESTs | E1-E2_ATPase; Hydrolase | 12.9 |
| 458493 | AV649408 | Hs. 282418 | ESTs | RYDR_ITPR | 12.8 |
| 444181 | AB033063 | Hs. 10491 | KIAA1237 protein | fn3, ig, PH, RhoGEF | 12.8 |
| 422357 | AF016272 | Hs. 115418 | cadherin 16, KSP-cadherin | cadherin | 12.7 |
| 409632 | W74001 | Hs. 55279 | serine (or cysteine) proteinase inhibitor | serpin | 12.7 |
| 407000 | U12139 | | gb: Human alpha1(XI) collagen (COL1 | TSPN, Collagen:COLFI | 12.6 |
| 417064 | W02903 | Hs. 15440 | ESTs | lectin_c | 12.6 |
| 439389 | AA318940 | Hs. 56004 | ESTs | hemopexin, Peptidase_M10 | 12.6 |
| 407786 | AA687538 | Hs. 38972 | tetraspan 1 | transmembrane4 | 12.5 |
| 410498 | AA355749 | | gb: EST64459 Jurkat T-cells VI Homo | aa_permeases | 12.5 |
| 422487 | AJ010901 | Hs. 198267 | mucin 4, tracheobronchial | vwd | 12.5 |
| 422330 | D30783 | Hs. 115263 | epiregulin | EGF | 12.5 |
| 402425 | | | predicted exon | ion_trans | 12.4 |
| 414875 | H42679 | Hs. 77522 | major histocompatibility complex, clas | ig | 12.2 |
| 424239 | AA67439 | Hs. 143526 | dopamine receptor D5 | 7tm_1 | 12.2 |
| 442622 | NM_000435 | Hs. 8546 | Notch (Drosophila) homolog 3 | EGF, ank, notch | 12.2 |
| 405368 | | | predicted exon | 7tm_1 | 12.2 |
| 402406 | | | predicted exon | Gal-bind_lectin | 12.1 |
| 426514 | BE616633 | Hs. 301122 | bone morphogenetic protein 7 (osteoge | TGF-beta, TGFb_propeptide | 12.1 |
| 406811 | U82979 | Hs. 67846 | leukocyte immunoglobulin-like recepto | ig | 12.0 |
| 416441 | BE407197 | | gb: 601301552F1 NIH_MGC_21 Homo | SDF | 12.0 |
| 433221 | AB040917 | Hs. 97860 | KIAA1484 protein | fn3, ig, LRRCT | 11.9 |
| 442915 | AA852875 | Hs. 8850 | a disintegrin and metalloproteinase dom | disintegrin, Reprolysin; | 11.9 |
| 423613 | AF036035 | Hs. 129910 | hyaluronoglucosaminidase 3 | ig, Sema, Acetyltransf | 11.9 |
| 411213 | AA676939 | Hs. 69285 | neuropilin 1 | CUB, MAM, F5_F8_type_C | 11.9 |
| 425483 | AF231022 | Hs. 301273 | *Homo sapiens* protocadherin Fat 2 (FA | EGF; cadherin, laminin_G | 11.8 |
| 421258 | AA286731 | | gb: zs53d08 r1 NCI_CGAP_GCB1 Hom | 7tm_3 | 11.8 |
| 423795 | AW849759 | | gb: IL3-CT0216-240200-077-C04 CT0 | arf, ras | 11.7 |
| 422424 | AI186431 | Hs. 116577 | prostate differentiation factor | TGF-beta | 11.7 |
| 443296 | AI765286 | | gb: wi73b05 x1 NCI_CGAP_Kid12 Ho | ig | 11.7 |
| 448999 | AF179274 | Hs. 22791 | transmembrane protein with EGF-like | kazal | 11.7 |
| 414878 | AA341040 | Hs. 77541 | ADP-ribosylation factor 5 | arf, ras | 11.5 |
| 429344 | R94038 | Hs. 199538 | inhibin, beta C | TGF-beta | 11.5 |
| 402114 | | | predicted exon | laminin_EGF, laminin_G | 11.5 |
| 419216 | AU076718 | Hs. 164021 | small inducible cytokine subfamily B ( | IL8 | 11.5 |
| 430263 | D12614 | Hs. 36 | lyphotoxin alpha (TNF superfamily, m | TNF | 11.4 |
| 400464 | | | predicted exon | Peptidase_S9 | 11.4 |
| 456841 | AA875863 | Hs. 152345 | poliovirus receptor-related 1 (herpesvir | ig | 11.4 |
| 409420 | Z15008 | Hs. 54451 | laminin, gamma 2 (nicein (100 kD), kal | luminin_EGF, laminin_B | 11.4 |
| 418043 | AW377752 | Hs. 83341 | H sapiens mRNA for tyrosine kinase re | fn3; ig, pkinase | 11.3 |
| 426523 | S68616 | Hs. 170222 | solute carrier family 9 (sodium/hydrog | Na_H_Exchanger | 11.3 |
| 446051 | BE048061 | Hs. 153315 | ESTs | Reprolysin; disintegrin | 11.3 |
| 439710 | AF086543 | | gb: *Homo sapiens* full length insert cDN | Xlink | 11.3 |
| 416602 | NM_006159 | Hs. 79389 | nel (chicken)-like 2 | vwc, TSPN | 11.3 |
| 418299 | AA279530 | Hs. 83968 | integrin, beta 2 (antigen CD18 (p95), ly | integrin_B | 11.3 |
| 425721 | AC002115 | Hs. 159309 | uroplakin 1A | transmembrane4; COX6B; Ets | 11.2 |
| 409757 | NM_001898 | Hs. 123114 | cystatin SN | cystatin | 11.2 |
| 430630 | AW269920 | Hs. 2621 | cystatin A (stefin A) | 7tm_3, ANF_receptor | 11.2 |
| 429630 | M85289 | Hs. 211573 | heparan sulfate proteoglycan 2 (perleca | laminin_EGF, ig, ldl_recept_a | 11.1 |
| 427289 | AI097346 | Hs. 174203 | solute carrier family 1 (glutamate/neutr | SDF | 11.1 |
| 401248 | AB028989 | Hs. 88500 | mitogen-activated protein kinase 8 inte | vwa, vwd, TIL | 11.1 |
| 412627 | BE391959 | Hs. 74276 | chloride intracellular channel 1 | G-patch, ig, MutS_C | 11.1 |
| 420104 | U09825 | Hs. 1287 | zinc finger protein 173 | zf-C3HC4, SPRY, zf-B_box | 11.1 |
| 405275 | AB028989 | Hs. 88500 | mitogen-activated protein kinase 8 inte | vwa, vwd; TIL | 11.1 |
| 425864 | U56420 | Hs. 159903 | olfactory receptor, family 5, subfamily | 7tm_1 | 11.1 |
| 446745 | AW118189 | Hs. 156400 | ESTs | vwa | 11.1 |
| 441834 | AL138034 | Hs. 7979 | KIAA0736 gene product | sugar_tr | 11.0 |
| 450986 | BE241845 | Hs. 25744 | Novel human gene mapping to chomos | PH, RhoGAP, Gal-bind_lectin | 11.0 |

TABLE 4A-continued

ABOUT131 UP-REGULATED GENES ENCODING EXTRACELLULAR/CELL SURFACE PROTEINS, OVARIAN CANCER VERSUS NORMAL OVARY

| Pkey | Ex. Accn | UG ID | Title | PFAM | ratio |
|---|---|---|---|---|---|
| 416118 | N52773 | Hs. 167721 | ESTs | hemopexin; Peptidase_M10 | 11.0 |
| 443071 | AL080021 | Hs. 8986 | complement component 1, q subcompo | C1q, Collagen | 10.9 |
| 431247 | AL021578 | Hs. 278489 | matrilin 4 | EGF, vwa | 10.9 |
| 431449 | M55994 | Hs. 256278 | tumor necrosis factor receptor superfam | TNFR_c6 | 10.9 |
| 457044 | 373899 | Hs. 2131 | arginine vasopressin receptor 1A | 7tm_1 | 10.9 |
| 416319 | AI815601 | Hs. 79197 | CD83 antigen (activated B lymphocyte | ig | 10.8 |
| 402172 | | | predicted exon | ig | 10.7 |
| 424218 | AF031824 | Hs. 143212 | cystatin F (leukocystatin) | cystatin | 10.6 |
| 409208 | Y00093 | Hs. 51077 | integrin, alpha X (antigen CD11C (p15 | vwa | 10.6 |
| 426330 | M77235 | Hs. 169331 | sodium channel, voltage-gated, type V, | ion_trans; IQ | 10.6 |
| 439758 | AA845235 | Hs. 124470 | ESTs | transmembrane4 | 10.6 |
| 412429 | AV650262 | Hs. 75765 | GRO2 oncogene | IL8 | 10.6 |
| 449987 | AW079749 | Hs. 184719 | ESTs, Weakly similar to AF116721 11 | ABC_tran, ABC_membrane | 10.6 |
| 432408 | N39127 | Hs. 76391 | myxovirus (influenza) resistance 1, hom | ion_trans, K_tetra | 10.6 |
| 406672 | M26041 | Hs. 198253 | major histocompatibility complex, clas | ig, MHC_II_alpha | 10.5 |
| 419749 | X73608 | Hs. 93029 | sparc/osteonectin, cwcv and kazal-like | kazal, thyroglobulin_1 | 10.5 |
| 419086 | NM_000216 | Hs. 89591 | Kallmann syndrome 1 sequence | fn3; wap | 10.5 |
| 425009 | X58288 | Hs. 154151 | protein tyrosine phosphatase, receptor t | fn3, ig; Y_phosphatase, MAM | 10.5 |
| 423869 | BE409301 | Hs. 134012 | C1q-related factor | GTP_EFTU, EFG_C | 10.4 |
| 430209 | AF177941 | Hs. 235368 | Pro-(alpha)3(V) collagen | Collagen; COLFI; TSPN | 10.4 |
| 400834 | | | predicted exon | IRK | 10.4 |
| 442941 | AU076728 | Hs. 8867 | cysteine-rich, angiogenic inducer, 61 | Cys_knot, tsp_1, vwc, IGFBP | 10.4 |
| 403691 | | | predicted exon | tsp_1, Reprolysin | 10.4 |
| 430776 | AJ011021 | Hs. 247905 | potassium voltage-gated channel, subfa | ion_trans | 10.3 |
| 432342 | AL036128 | Hs. 274404 | plasminogen activator, tissue | EGF, fn1; kringle; trypsin | 10.3 |
| 413731 | BE243845 | Hs. 75511 | connective tissue growth factor | Cys_knot, top_1, vwc | 10.3 |
| 423309 | BE006775 | Hs. 126782 | sushi-repeat protein | sushi, HYR | 10.3 |
| 431728 | NM_007351 | Hs. 268107 | multimenn | EGF, C1q | 10.3 |
| 450245 | AA007536 | Hs. 271767 | ESTs, Moderately similar to ALU1_HU | ig | 10.2 |
| 446983 | AA157484 | Hs. 97199 | complement component C1q receptor | EGF; Xlink | 10.2 |
| 414320 | U13616 | Hs. 75893 | ankyrin 3, node of Ranvier (ankynn G) | death, ank; ZU5 | 10.1 |
| 400253 | | | predicted exon | 7tm_1 | 10.0 |
| 406694 | M94891 | Hs. 225932 | pregnancy specific beta-1-glycoprotein | ig | 10.0 |
| 418793 | AW382987 | Hs. 88474 | prostaglandin-endoperoxide synthase 1 | EGF | 10.0 |
| 410664 | NM_006033 | Hs. 65370 | lipase, endothelial | Ribosomal_L22 | 10.0 |
| 427274 | NM_005211 | Hs. 174142 | colony stimulating factor 1 receptor, fo | pkinase, ig | 10.0 |

Pkey: Pnmekey
Ex. Accn: Exemplar Accession
UG ID UniGene ID
Title: Unigene Title
PFAM domains
ratio: tumor vs normal ovary

TABLE 4B

| Pkey: | CAT Number | Accession |
|---|---|---|
| 410498 | 120611_1 | AA355749 AA085520 AW966333 AA340319 BE170938 |
| 416441 | 159480_1 | BE407197 AA182474 AA180369 BE275628 BE276131 |
| 421258 | 200725_1 | AA286731 AA287621 AW188228 AW137774 |
| 423795 | 232093_1 | AW849759 AW849758 T89549 AA331069 |
| 439710 | 47550_1 | AF086543 W96291 W96225 |
| 443296 | 56539_2 | AI765286 AW297086 BE568658 |

Pkey: Unique Eos probeset identifier number
CAT number: Gene cluster number
Accession Genbank accession numbers

TABLE 4C

| Pkey | Ref | Strand | Nt_position |
|---|---|---|---|
| 400464 | 9929670 | Plus | 22074–22214 |
| 400834 | 8705192 | Plus | 121963–122288 |
| 402114 | 8318586 | Plus | 71578–71715 |
| 402172 | 8575911 | Minus | 143378–143671 |
| 402406 | 3970929 | Plus | 10872–11123, 12932–13048 |
| 402425 | 9796347 | Minus | 50224–50395 |
| 403077 | 8954241 | Plus | 146923–147222, 147326–147628 |
| 403089 | 8954241 | Plus | 171964–172239 |
| 403691 | 7387384 | Minus | 88280–88463 |
| 405024 | 7107727 | Plus | 88500–88697 |
| 405285 | 6139075 | Minus | 55744–55903, 57080–57170, 61478–61560 |
| 405368 | 2104517 | Plus | 46055–47188 |

Pkey: Unique number corresponding to an Eos probeset
Ref: Sequence source. The 7 digit numbers in this column are Genbank Identifier (GI) numbers "Dunham I. et. al" refers to the publication entitled "The DNA sequence of human chromosome 22" Dunham, et. al (1999) Nature 402: 489–495
Strand: Indicates DNA strand from which exons were predicted
Nt_position: Indicates nucleotide positions of predicted exons TABLE 5A lists about 685 genes down-regulated in ovarian cancer compared to normal ovaries These were selected as for Table 3A, except that the numerator and denominator were switched, and the ratio was greater than or equal to 3.0 (i e 3 fold down-regulated in tumor vs normal ovary)

TABLE 5A

685 DOWN-REGULATED GENES, OVARIAN CANCER VERSUS NORMAL OVARY

| Pkey | Ex. Accn | UG ID | Title | ratio |
|---|---|---|---|---|
| 421013 | M62397 | Hs. 1345 | mutated in colorectal cancers | 14.8 |
| 439360 | AA448488 | Hs. 55346 | ESTs, Weakly similar to Z141_HUMAN ZINC FINGE | 12.8 |
| 407644 | D16815 | Hs. 37288 | nuclear receptor subfamily 1, group D, member 2 | 12.6 |
| 424851 | AA676441 | Hs. 119059 | ESTs | 11.6 |
| 455056 | AW853057 | | gb: RC1-CT0249-170200-025-h04 CT0249 Homo sapie | 11.5 |
| 420727 | H75701 | Hs. 99886 | complement component 4-binding protein, beta | 11.3 |
| 451617 | C01056 | Hs. 168000 | ESTs | 10.0 |
| 401308 | | | predicted exon | 9.9 |
| 440987 | AA911705 | Hs. 130229 | ESTs | 9.7 |
| 409725 | T40760 | Hs. 90459 | EST | 9.7 |
| 415752 | BE314524 | Hs. 78776 | putative transmembrane protein | 9.7 |
| 437690 | AA804362 | Hs. 180544 | ESTs | 9.6 |
| 437787 | AI908263 | Hs. 291625 | ESTs | 9.5 |
| 459054 | AW798466 | Hs. 82396 | 2',5'-oligoadenylate syathetase 1 | 9.2 |
| 435330 | R16769 | Hs. 185689 | ESTs | 9.2 |
| 436642 | AA724430 | Hs. 127960 | ESTs | 9.1 |
| 453752 | AL120800 | | gb: DKFZp762E152_r1 762 (synonym: hmel2) Homo sa | 9.1 |
| 451683 | AI808964 | Hs. 207673 | ESTs | 9.1 |
| 401464 | AF039241 | Hs. 9028 | histone deacetylase 5 | 9.0 |
| 436812 | AW298067 | | gb: UI-H-BW0-ajp-g-09-0-UI.s1 NCI_CGAP_Sub6 Hom | 8.7 |
| 410758 | BE535988 | | gb: 601062418F1 NIH_MGC_10 Homo sapiens cDNA | 8.7 |
| 412637 | AA115097 | Hs. 261313 | ESTs | 8.4 |
| 419166 | AA234638 | Hs. 293584 | ESTs | 8.3 |
| 423739 | AA398155 | Hs. 97600 | ESTs | 8.1 |
| 413813 | M96956 | Hs. 75561 | teratocarcinoma-derived growth factor 1 | 8.1 |
| 416211 | R14625 | | gb: yg45c03.r1 Soares infant brain 1 NIB Homo sapiens | 8.0 |
| 443131 | AI033833 | Hs. 132689 | ESTs | 7.9 |
| 415866 | T10115 | Hs. 92423 | KIAA1566 protein | 7.9 |
| 410130 | AI912097 | Hs. 163208 | ESTs | 7.9 |
| 439426 | AI131502 | Hs. 143135 | ESTs, Weakly similar to FAFY_HUMAN PROBABLE | 7.8 |
| 408141 | U69205 | Hs. 45152 | ESTs, Moderately similar to neurogenic basic-helix-loop | 7.7 |
| 419015 | T79262 | Hs. 14463 | ESTs | 7.6 |
| 441573 | BE563966 | Hs. 6529 | ESTs | 7.5 |
| 419386 | AA236867 | Hs. 143868 | ESTs | 7.5 |
| 430562 | D78260 | Hs. 285097 | ESTs | 7.5 |
| 434738 | AA836265 | | gb: od17e02 s1 NCI_CGAP_CGB1 Homo sapiens cDNA | 7.4 |
| 403283 | | | predicted exon | 7.4 |
| 415861 | Z43123 | Hs. 144513 | ESTs | 7.4 |
| 412732 | AW993300 | | gb: RC2-BN0033-180200-015-g06 BN0033 Homo sapie | 7.4 |
| 441247 | AW118681 | Hs. 128051 | ESTs | 7.4 |
| 442865 | N57659 | Hs. 114541 | ESTs, Weakly similar to neuronal thread protein AD7c- | 7.3 |
| 409699 | BE154650 | | gb: PM3-HT0344-071299-003-c08 HT0344 Homo sapie | 7.3 |
| 420352 | BE258835 | | gb: 601117374F1 NIH_MGC_16 Homo sapiens cDNA | 7.3 |
| 421418 | AA806639 | | gb: ob88g05 s1 NCI_CGAP_GCB1 Homo sapiens cDN | 7.2 |
| 413597 | AW302885 | Hs. 117183 | ESTs | 7.2 |
| 454102 | AW752363 | | gb: RC0-CT0201-270999-011-f03 CT0201 Homa sapien | 7.1 |
| 445487 | AI806287 | Hs. 201217 | ESTs | 7.1 |
| 457604 | AI004397 | Hs. 130558 | ESTs, Weakly similar to similar to O-sialoglycoprotein | 7.1 |
| 400942 | | | predicted exon | 6.9 |
| 407596 | R86913 | | gb: yq30f05 r1 Soares fetal liver spleen 1NFLS Homo sa | 6.9 |
| 422046 | AI638562 | | gb: ts50a10.x1 NCI_CGAP_Ut1 Homo sapiens cDNA c | 6.9 |
| 441284 | AA927676 | Hs. 196542 | ESTs | 6.9 |
| 446224 | AW450551 | Hs. 13308 | ESTs | 6.9 |
| 424943 | AU077260 | Hs. 153924 | death-associated protein kinase 1 | 6.9 |
| 453967 | AW009077 | Hs. 232947 | ESTs | 6.9 |
| 448683 | AA167642 | Hs. 14632 | ESTs | 6.8 |
| 431877 | AA521204 | Hs. 105507 | ESTs | 6.8 |
| 411337 | AW837349 | | gb: QV2-LT0038-270300-108-d12 LT0038 Homo sapie | 6.8 |
| 410596 | AA374186 | | gb: EST86290 HSC172 cells I Homo sapiens cDNA 5' e | 6.8 |
| 417762 | AA205976 | | gb: zq48a10 r1 Stratagene hNT neuron (937233) Homo | 6.7 |
| 406364 | | | predicted exon | 6.7 |
| 452238 | F01811 | Hs. 187931 | ESTs, Moderately similar to S22703 voltage-gated pota | 6.7 |
| 415288 | R15794 | Hs. 141027 | ESTs, Weskly similar to ALU1_HUMAN ALU SUBFA | 6.7 |
| 407437 | AF220264 | | gb: Homo sapiens MOST-1 mRNA, complete cds | 6.7 |
| 439126 | AF085984 | | gb: Homo sapiens full length insert cDNA close YT99F | 6.6 |
| 452453 | AI902519 | | gb: QV-BT009-101198-051 BT009 Homo sapiens cDNA | 6.6 |
| 431800 | AW452768 | Hs. 162045 | ESTs | 6.5 |
| 426380 | AI291267 | Hs. 149990 | ESTs, Weakly similar to unnamed protein product [H sa | 6.5 |
| 449529 | AI990559 | Hs. 232033 | ESTs | 6.4 |
| 437755 | AW204256 | Hs. 291887 | ESTs | 6.4 |
| 448307 | AI480289 | Hs. 211026 | ESTs | 6.4 |
| 439586 | AA922936 | Hs. 110039 | ESTs | 6.4 |
| 420051 | N35696 | Hs. 44745 | ESTs | 6.4 |
| 425806 | AI522299 | Hs. 173369 | ESTs | 6.4 |
| 433923 | AI823453 | Hs. 146625 | ESTs | 6.4 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 408159 | H63977 | Hs. 118526 | ESTs | 6.3 |
| 434844 | AF157116 | Hs. 301355 | hypothetical protein LOC56757 | 6.3 |
| 430197 | AA468888 | Hs. 187697 | ESTs, Weakly similar to ALU5_HUMAN ALU SUBFA | 6.3 |
| 440332 | AI218517 | Hs. 188051 | ESTs | 6.3 |
| 450061 | AI797034 | Hs. 201115 | ESTs | 6.3 |
| 454994 | AW850176 | | gb: IL3-CT0219-271099-022-H04 CT0219 Homo sapien | 6.3 |
| 402105 | | | predicted exon | 6.3 |
| 409090 | W56067 | Hs. 103105 | ESTs | 6.2 |
| 405752 | | | predicted exon | 6.2 |
| 408074 | R20723 | Hs. 124764 | ESTs | 6.2 |
| 459200 | Y09306 | Hs. 30148 | homeodomain-interacting protein kinase 3 | 6.1 |
| 416310 | T81421 | Hs. 221396 | ESTs | 6.1 |
| 421976 | AL138443 | Hs. 23450 | mRNA for FLJ00023 protein | 6.1 |
| 429755 | NM_001364 | Hs. 215839 | discs, large (Drosophila) homolog 2 (chapsyn-110) | 6.0 |
| 448732 | BE614063 | | gb: 601503993F1 NIH_MGC_71 Homo sapiens cDNA | 6.0 |
| 453909 | AW004045 | Hs. 203365 | ESTs | 6.0 |
| 431178 | AA493884 | Hs. 218008 | Homo sapiens cDNA FLJ21440 fis, clone COL04389 | 6.0 |
| 449671 | AW959755 | Hs. 288896 | Homo sapiens cDNA FLJ12977 fis, clone NT2RP20062 | 6.0 |
| 421349 | W01715 | Hs. 102958 | ESTs, Weakly similar to Lpg6p [S. cerevisiae] | 6.0 |
| 453282 | AK000043 | Hs. 32922 | hypothetical protein FLJ20036 | 5.9 |
| 420618 | AA278781 | Hs. 280698 | ESTs | 5.9 |
| 412480 | BE142364 | | gb: CM0-HT0143-270999-062-d12 HT0143 Homo sapi | 5.9 |
| 449858 | AW205979 | Hs. 196065 | ESTs | 5.9 |
| 429884 | AL049925 | Hs. 225984 | DKFZP547G0910 protein | 5.9 |
| 416453 | H56968 | Hs. 114593 | ESTs | 5.9 |
| 459497 | AA825742 | Hs. 87517 | ESTs | 5.9 |
| 433773 | AA759293 | Hs. 112692 | ESTs | 5.9 |
| 458942 | AA009647 | Hs. 8850 | a disintegrin and metalloproteinase domain 12 (meltrin a | 5.9 |
| 436054 | AI076262 | Hs. 119813 | ESTs | 5.9 |
| 410495 | N95428 | | gb: zb80d09.s1 Soares_senescent_fibroblasts_NbHSF H | 5.8 |
| 403277 | | | predicted exon | 5.8 |
| 444302 | AI140115 | Hs. 225130 | ESTs | 5.8 |
| 439834 | AI754576 | Hs. 124523 | ESTs | 5.8 |
| 404020 | | | predicted exon | 5.8 |
| 454338 | AW381251 | Hs. 1050 | pleckatrin homology, Sec7 and coiled/coil domains 1(cy | 5.7 |
| 430922 | AW373747 | Hs. 183337 | ESTs | 5.7 |
| 420289 | N55394 | Hs. 96398 | 8-oxoguanine DNA glycosylase | 5.7 |
| 428498 | AA429575 | Hs. 243032 | ESTs | 5.7 |
| 445597 | H65649 | | gb: yr72d10 r1 Soares fetal liver spleen 1NFLS Homo sa | 5.7 |
| 411543 | AW851248 | | gb: IL3-CT0220-160200-066-F01 CT0220 Homo sapien | 5.7 |
| 408354 | AI382803 | Hs. 159235 | ESTs | 5.7 |
| 444431 | AW513324 | Hs. 42280 | ESTs | 5.7 |
| 406605 | | | predicted exon | 5.7 |
| 405541 | AF039241 | Hs. 9028 | histone deacetylase 5 | 5.6 |
| 458090 | AI282149 | Hs. 56213 | ESTs, Highly similar to FXD3_HUMAN FORKHEAD | 5.6 |
| 454529 | Z45439 | Hs. 270425 | ESTs | 5.6 |
| 445832 | AI261545 | | gb: qz30a07 x1 NCI_CGAP_Kid11 Homo sapiens cDNA | 5.6 |
| 441223 | AI475067 | Hs. 132499 | ESTs | 5.6 |
| 432552 | AI537170 | Hs. 173725 | ESTs, Weakly similar to ALU8_HUMAN ALU SUBFA | 5.6 |
| 443650 | AI698330 | Hs. 151444 | ESTs | 5.6 |
| 403714 | | | predicted exon | 5.6 |
| 444165 | AL137443 | Hs. 10441 | hypothetical protein FLJ11236 | 5.6 |
| 458914 | BE327696 | Hs. 280922 | ESTs | 5.6 |
| 420620 | AA278807 | Hs. 173343 | ESTs | 5.5 |
| 458228 | AA934995 | Hs. 184846 | ESTs, Weakly similar to R28830 1 [H. sapiens] | 5.5 |
| 448067 | R68568 | Hs. 183373 | src homology 3 domain-containing protein HIP-55 | 5.5 |
| 427000 | AI187420 | Hs. 145221 | ESTs | 5.5 |
| 452351 | AA025647 | | gb: ze85d01.r1 Soares_fetal_heart_NbHH19W Homo sa | 5.5 |
| 459359 | N99545 | | gb: za40a05.r1 Soares fetal liver spleen 1 NFLS Homo sa | 5.5 |
| 408385 | AF055634 | Hs. 44553 | unc5 (C. elegans homolog) c | 5.5 |
| 450938 | AW753734 | Hs. 277215 | ESTs | 5.5 |
| 431888 | H99557 | Hs. 2864 | early endosome antigen 1, 162 kD | 5.4 |
| 459418 | W96550 | Hs. 26418 | ESTs | 5.4 |
| 416718 | R83017 | Hs. 204828 | ESTs | 5.4 |
| 413236 | H16442 | Hs. 127376 | KIAA0266 gene product | 5.4 |
| 439063 | AF085922 | Hs. 113968 | ESTs | 5.4 |
| 446361 | AI291234 | Hs. 282241 | ESTs | 5.4 |
| 458253 | AW296952 | Hs. 196802 | ESTs | 5.4 |
| 433682 | AA642418 | Hs. 17381 | ESTs | 5.4 |
| 455790 | BE090690 | | gb: RC1-BT0720-280300-011-g02 BT0720 Homo sapie | 5.4 |
| 445755 | AW294870 | Hs. 223672 | ESTs | 5.3 |
| 436513 | AJ278110 | Hs. 125507 | DEAD-box protein | 5.3 |
| 416671 | N94087 | Hs. 26073 | ESTs, Moderately similar to HG14_HUMAN NONHIS | 5.3 |
| 440231 | AW015420 | Hs. 163323 | ESTs | 5.3 |
| 429866 | AA460104 | Hs. 99540 | ESTs | 5.3 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 437779 | AA345232 | Hs. 21227 | ESTs | 5.3 |
| 424029 | AB014594 | Hs. 137579 | KIAA0694 gene product | 5.3 |
| 425614 | AI334963 | Hs. 156256 | ESTs | 5.3 |
| 430653 | AW902062 | Hs. 30280 | ESTs | 5.2 |
| 408855 | T83061 | Hs. 279604 | desmin | 5.2 |
| 410454 | AW749041 | | gb: RC3-BT0319-100100-012-c05 BT0319 Homo sapie | 5.2 |
| 438116 | AI904105 | Hs. 122016 | ESTs | 5.2 |
| 409138 | W73159 | Hs. 58290 | ESTs | 5.2 |
| 423047 | NM_005323 | Hs. 123064 | Hi histone family, member T (testis-specific) | 5.2 |
| 440212 | AW300959 | Hs. 126216 | ESTs, Weakly similar to good similarity to E coli hypo | 5.2 |
| 404108 | | | predicted exon | 5.2 |
| 456253 | T12198 | | gb: A568F Heart *Homo sapiens* cDNA clone A588, mRN | 5.2 |
| 409365 | AA702376 | Hs. 226440 | *Homo sapiens* close 24881 mRNA sequence | 5.1 |
| 444013 | T08531 | Hs. 44404 | hypothetical protein PRO1488 | 5.1 |
| 454071 | AI041793 | Hs. 42502 | ESTs | 5.1 |
| 419761 | M17373 | Hs. 93177 | interferon, beta 1, fibroblast | 5.1 |
| 451250 | AA491275 | Hs. 236940 | *Homo sapiens* cDNA FLJ12542 fis, clone NT2RM4000 | 5.1 |
| 405290 | | | predicted exon | 5.1 |
| 454487 | AW796342 | | gb: PM2-UM0027-230200-002-h02 UM0027 Homo sap | 5.1 |
| 444131 | AI806600 | Hs. 207119 | EST, Weakly similar to intrinsic factor-B12 receptor pr | 5.1 |
| 441679 | BE502267 | Hs. 65996 | ESTs | 5.1 |
| 450077 | AA523752 | Hs. 120855 | ESTs | 5.1 |
| 421209 | AJ010230 | Hs. 102576 | ret finger protein-like 1 antisense | 5.1 |
| 445140 | AI650599 | Hs. 197913 | ESTs | 5.1 |
| 421126 | M74587 | Hs. 102122 | insulin-like growth factor binding protein 1 | 5.1 |
| 447037 | AI357568 | Hs. 157612 | ESTs | 5.1 |
| 407168 | R45175 | | gb: yg40f01.s1 Soares infant brain 1NIB *Homo sapiens* | 5.0 |
| 436196 | AK001084 | | gb: *Homo sapiens* cDNA FLJ110222 fin, clone HEMBB1 | 5.0 |
| 442772 | AW503680 | Hs. 300513 | ESTs, Weakly similar to T15B7 2 [*C. elegans*] | 5.0 |
| 444138 | AI701572 | Hs. 151153 | ESTs | 5.0 |
| 458589 | AV654623 | Hs. 288141 | *Homo sapiens* cDNA FLJ13016 fis, clone NT2RP30006 | 5.0 |
| 451640 | AA195601 | Hs. 26771 | Human DNA sequence from clone 747H23 on chromos | 5.0 |
| 441318 | AI078234 | Hs. 176130 | ESTs | 5.0 |
| 407490 | S79281 | | gb: pancreatic ribonuclease [human, mRNA Recombinan | 4.9 |
| 438224 | AA933999 | | gb: on91f04.s1 Soares_NFL_T_GBC_S1 *Homo sapiens* | 4.9 |
| 451638 | AW798466 | Hs. 82396 | 2',5'-oligoadenylate synthetase 1 | 4.9 |
| 457356 | AA489621 | Hs. 191670 | ESTs | 4.9 |
| 430679 | R44428 | Hs. 22801 | ESTs | 4.9 |
| 445747 | AI820863 | Hs. 145328 | ESTs, Weakly similar to ALU1_HUMAN ALU SUBFA | 4.9 |
| 409036 | T88693 | Hs. 226410 | ESTs | 4.9 |
| 433382 | T64293 | Hs. 291453 | ESTs | 4.9 |
| 401287 | | | predicted exon | 4.9 |
| 424188 | AW954552 | Hs. 142634 | zinc finger protein | 4.9 |
| 404868 | | | predicted exon | 4.9 |
| 410152 | AW593104 | Hs. 23681 | ESTs | 4.9 |
| 444997 | AI204451 | Hs. 146196 | ESTs | 4.9 |
| 431075 | BE267477 | | gb: 601189542F2 NIH_MGC_7 *Homo sapiens* cDNA cl | 4.8 |
| 429033 | NM_007374 | Hs. 194756 | sine oculis homeobox (Drosophila) homolog 6 | 4.8 |
| 414337 | BE386606 | | gb: 601273980F1 NIH_MGC_20 *Homo sapiens* cDNA | 4.8 |
| 410336 | BE391510 | Hs. 18498 | *Homo sapiens* cDNA FLJ12277 fis, clone MAMMA10 | 4.8 |
| 445283 | AW515763 | Hs. 246872 | ESTs | 4.8 |
| 434792 | AA649253 | Hs. 132458 | ESTs | 4.8 |
| 433403 | AF040247 | | gb: *Homo sapiens* erythroid differentiation-related factor | 4.8 |
| 454940 | AW846202 | | gb: QV0-CT0179-011299-061-f10 CT0179 Homo sapie | 4.8 |
| 455534 | AW991925 | | gb: PM3-BN0011-130100-002-b07 BN0011 Homo sapi | 4.8 |
| 416437 | N48990 | Hs. 37204 | ESTs | 4.8 |
| 433767 | AA609245 | | gb: afl3a11.s1 Soares_testis_NHT *Homo sapiens* cDNA | 4.8 |
| 434977 | AI734233 | Hs. 226142 | ESTs, Weakly similar to ALU7_HUMAN ALU SUBFA | 4.8 |
| 416192 | NM_005036 | Hs. 998 | peroxisome proliferative activated receptor, alpha | 4.8 |
| 459218 | AA812633 | Hs. 10845 | ESTs | 4.8 |
| 402109 | | | predicted exon | 4.8 |
| 444490 | AI151080 | Hs. 146830 | ESTs | 4.8 |
| 432632 | AW973801 | Hs. 134656 | ESTs | 4.8 |
| 438683 | AA813982 | Hs. 291842 | ESTs | 4.8 |
| 404044 | | | predicted exon | 4.8 |
| 449862 | AI672277 | Hs. 199475 | ESTs | 4.8 |
| 419002 | T78625 | Hs. 268594 | ESTs | 4.7 |
| 425582 | AL157686 | Hs. 293737 | ESTs | 4.7 |
| 416086 | H18252 | Hs. 227263 | ESTs | 4.7 |
| 441133 | AA918191 | Hs. 194457 | ESTs | 4.7 |
| 446323 | AI288274 | Hs. 149868 | ESTs | 4.7 |
| 440347 | AI125590 | Hs. 142864 | ESTs | 4.7 |
| 439481 | AF086294 | Hs. 125844 | ESTs | 4.6 |
| 456388 | W28557 | | gb: 48d8 Human retina cDNA randomly primed sublibra | 4.6 |
| 441864 | R34177 | Hs. 181315 | ESTs, Moderately similar to ALU4_HUMAN ALU SU | 4.6 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 445910 | R93483 | Hs. 260273 | ESTs | 4.6 |
| 403531 | | | predicted exon | 4.6 |
| 429773 | AI332482 | Hs. 218791 | proteoglycan 4, (megakaryocyte stimulating factor, artic | 4.6 |
| 422563 | BE299342 | Hs. 19348 | Homo sapiens cDNA FLJ13119 fis, clone NT2RP30026 | 4.6 |
| 422890 | Z43784 | Hs. 78713 | solute carrier family 25 (mitochondrial carrier; phospha | 4.6 |
| 453663 | AL048807 | Hs. 180714 | cytochrome c oxidase subunit VIa polypeptide 1 | 4.6 |
| 447839 | N72050 | Hs. 164144 | ESTs | 4.5 |
| 415612 | F12893 | Hs. 13301 | ESTs | 4.5 |
| 433371 | T25451 | | gb: PTHI188 HTCDL1 Homo sapiens cDNA 5'/3' simila | 4.5 |
| 410667 | AW936099 | | gb: QV0-DT0020-210100-095-d04 DT0020 Homo sapie | 4.5 |
| 410890 | AW809575 | | gb: MR4-ST0121-060200-002-a12 ST0121 Homo sapie | 4.5 |
| 404451 | | | predicted exon | 4.5 |
| 441705 | AI087052 | Hs. 55993 | ESTs | 4.5 |
| 439597 | W79579 | Hs. 58552 | ESTs | 4.5 |
| 407825 | NM_006152 | Hs. 40202 | lymphoid-restricted membrane protein | 4.5 |
| 423073 | BE252922 | Hs. 123119 | MAD (mothers against decapentaplegic, Drosophila) ho | 4.5 |
| 456278 | BE300369 | Hs. 42643 | ESTs, Weakly similar to KIAA1016 protein [H. sapiens | 4.5 |
| 424719 | H90452 | | gb: yv01c03.r1 Soares fetal liver spleen 1NFLS Homo sa | 4.5 |
| 439542 | AW297571 | Hs. 17646 | ESTs | 4.5 |
| 444433 | AV649844 | Hs. 282436 | ESTs | 4.5 |
| 438831 | BE263273 | Hs. 301128 | ESTs | 4.5 |
| 410065 | AW812744 | | gb: RC3-ST0186-181099-012-c09 ST0186 Homo sapien | 4.5 |
| 453895 | AA039843 | Hs. 61948 | ESTs | 4.5 |
| 458250 | AI807339 | Hs. 152174 | ESTs, Weakly similar to Z140_HUMAN ZINC FINGE | 4.5 |
| 423403 | AA325483 | | gb: EST28475 Cerebellem II Homo sapiens cDNA 5' en | 4.5 |
| 454679 | AW813110 | | gb: CM4-ST0189-051099-021-f05 ST0189 Homo sapien | 4.5 |
| 445368 | AI221631 | Hs. 166788 | ESTs | 4.5 |
| 401004 | | | predicted exon | 4.5 |
| 425837 | AF007567 | Hs. 159609 | insulin receptor substrate 4 | 4.5 |
| 420497 | AW206285 | Hs. 253548 | ESTs | 4.5 |
| 449438 | AA927317 | Hs. 176719 | ESTs | 4.5 |
| 429409 | AI694817 | Hs. 155980 | ESTs | 4.5 |
| 447959 | AI452784 | Hs. 270270 | ESTs | 4.4 |
| 407340 | AA810168 | Hs. 232119 | ESTs | 4.4 |
| 424326 | NM_014479 | Hs. 145296 | disintegrin protease | 4.4 |
| 443479 | AF027219 | Hs. 9443 | zinc finger protein 202 | 4.4 |
| 443246 | T75157 | Hs. 285516 | ESTs, Weakly similar to hypothetical protein [H. sapien | 4.4 |
| 414475 | BE302955 | Hs. 119598 | ribosomal protein L3 | 4.4 |
| 432075 | AW972934 | | gb: EST385030 MAGE resequences, MAGM Homo sap | 4.4 |
| 417906 | R24769 | Hs. 23725 | ESTs | 4.4 |
| 406518 | W28077 | Hs. 79389 | nel (chicken)-like 2 | 4.4 |
| 441460 | AI962478 | Hs. 226804 | ESTs, Moderately similar to ALUC_HUMAN !!!! ALU | 4.4 |
| 450549 | T49427 | Hs. 181244 | major histocompatibility complex, class I, A | 4.4 |
| 426528 | AA380828 | | gb: EST93827 Activated T-cells VII Homo sapiens cDN | 4.4 |
| 430535 | AW968485 | | gb: EST380561 MAGE resequences, MAGJ Homo sapi | 4.4 |
| 408479 | BE047329 | Hs. 144483 | ESTs | 4.3 |
| 448636 | AI557139 | Hs. 129179 | Homo sapiens cDNA FLJ13581 fis, clone PLACE10090 | 4.3 |
| 411280 | N50617 | | gb: yy89h02.r1 Soares_multiple_sclerosis_2NbHMSP H | 4.3 |
| 440790 | AW593050 | Hs. 128580 | ESTs | 4.3 |
| 458301 | AF003834 | | gb: AF003834 Clontech HI1149x Homo sapiens cDNA | 4.3 |
| 442277 | AW448914 | Hs. 202391 | ESTs | 4.3 |
| 449463 | AI657038 | Hs. 196109 | ESTs | 4.3 |
| 433426 | H69125 | Hs. 133525 | ESTs | 4.3 |
| 410782 | AW504860 | Hs. 288836 | Homo sapiens cDNA FLJ12673 fis, clone NT2RM4002 | 4.3 |
| 423040 | AA320749 | Hs. 209464 | KIAA1604 protein | 4.3 |
| 432430 | AW079984 | Hs. 262480 | ESTs | 4.3 |
| 432072 | N62937 | Hs. 269109 | ESTs | 4.3 |
| 452213 | AL110237 | Hs. 28425 | Homo sapiens mRNA, cDNA DKFZp566D224 (from c | 4.3 |
| 403635 | | | predicted exon | 4.3 |
| 441919 | AI553802 | Hs. 128121 | ESTs | 4.3 |
| 416717 | H79559 | Hs. 297726 | ESTs | 4.3 |
| 430995 | NM_005092 | Hs. 248197 | tumor necrosis factor (ligand) superfamily, member 18 | 4.2 |
| 429269 | AA449013 | Hs. 99203 | ESTs | 4.2 |
| 415840 | R15955 | Hs. 21758 | ESTs | 4.2 |
| 451300 | AA017066 | Hs. 237686 | EST | 4.2 |
| 445366 | AI221511 | Hs. 298662 | ESTs | 4.2 |
| 424194 | BE245833 | Hs. 169854 | hypothetical protein SP192 | 4.2 |
| 459105 | NM_014517 | Hs. 28423 | upstream binding protein 1 (LBP-1a) | 4.2 |
| 455387 | BE069037 | | gb: QV3-BT0379-161299-040-e12 BT0379 Homo sapie | 4.2 |
| 410507 | AA355288 | Hs. 271408 | ESTs | 4.2 |
| 453823 | AL137967 | | gb: DKFZp761D2315_r1 761 (synonym hamy2) Homo | 4.2 |
| 450966 | AA017245 | Hs. 32794 | ESTs | 4.2 |
| 432694 | AW991585 | Hs. 276755 | ESTs, Weakly similar to F53B1.2 [C. elegans] | 4.2 |
| 455108 | AW856866 | | gb: RC0-CT0299-291199-031-G02 CT0299 Homo sapie | 4.2 |
| 443609 | AV650231 | Hs. 282941 | ESTs | 4.2 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 427469 | AA403084 | Hs. 269347 | ESTs | 4.2 |
| 417178 | N51636 | | gb: yy87b01.s1 Soares_multiple_sclerosis_2NbHMSP H | 4.2 |
| 439751 | AA196090 | Hs. 50794 | *Homo sapiens* mRNA full length insert cDNA clone EU | 4.2 |
| 431982 | AW419296 | Hs. 105754 | ESTs | 4.1 |
| 442641 | AI890955 | Hs. 262983 | ESTs | 4.1 |
| 422128 | AW881145 | | gb: QV0-OT0033-010400-182-a07 OT0033 Homo sapie | 4.1 |
| 449156 | AF103907 | Hs. 171353 | prostate cancer antigen 3 | 4.1 |
| 419668 | AI033098 | Hs. 132777 | ESTs | 4.1 |
| 418236 | AW994005 | Hs. 172572 | hypothetical protein FLJ20093 | 4.1 |
| 432663 | AI984317 | Hs. 122589 | ESTs | 4.1 |
| 448313 | BE622486 | Hs. 121688 | *Homo sapiens* cDNA FLJ13463 fis, clone PLACE10034 | 4.1 |
| 411279 | AW884776 | | gb: QV4-OT0067-010300-121-d01 OT0067 Homo sapie | 4.1 |
| 440652 | AI216751 | Hs. 143977 | ESTs | 4.1 |
| 416608 | R11499 | Hs. 189716 | ESTs | 4.1 |
| 420405 | AA743396 | Hs. 189023 | ESTs | 4.1 |
| 405717 | | | predicted exon | 4.1 |
| 435267 | N23797 | Hs. 110114 | ESTs | 4.1 |
| 412228 | AW503785 | Hs. 73792 | complement component (3d/Epstein Barr virus) recepto | 4.1 |
| 403560 | AI929721 | Hs. 5120 | dynein, cytoplasmic, light polypeptide | 4.1 |
| 449162 | AI632740 | Hs. 10476 | ESTs | 4.1 |
| 459157 | AI904385 | | gb: CM-BT054-080399-054 BT054 *Homo sapiens* cDN | 4.1 |
| 432474 | AA584042 | | gb: nn65e09.s1 NCI_CGAP_Lar1 *Homo sapiens* cDNA | 4.1 |
| 455388 | AW936234 | | gb: QV0-DT002-090200-106-g05 DT0020 Homo sapie | 4.0 |
| 426456 | AA580748 | Hs. 130658 | ESTs | 4.0 |
| 438597 | AA811662 | Hs. 171497 | ESTs | 4.0 |
| 437934 | AW880871 | Hs. 77496 | small nuclear ribonucleoprotein polypeptide G | 4.0 |
| 459385 | BE380047 | | gb: 601159362F2 NIH_MGC_53 *Homo sapiens* cDNA | 4.0 |
| 436404 | AW968556 | Hs. 137240 | *Homo sapiens* mRNA for partial 3'UTR, sequence 2 | 4.0 |
| 457740 | AW500458 | | gb: UI-HF-BN0-akb-d-07-0-UI.r1 NIH_MGC_50 Homo | 4.0 |
| 437385 | AA757055 | Hs. 164060 | ESTs | 4.0 |
| 444530 | AV650124 | Hs. 282435 | ESTs | 4.0 |
| 408066 | AA046914 | | gb: zf47h10.r1 Soares retina N2b4HR *Homo sapiens* cD | 4.0 |
| 411256 | AW834039 | | gb: QV0-TT0010-091199-053-e09 TT001 Homo sapie | 4.0 |
| 433582 | BE548749 | Hs. 148016 | ESTs | 4.0 |
| 438637 | BE500941 | Hs. 126730 | ESTs, Weakly similar to KIAA1214 protein [*H. sapiens* | 4.0 |
| 414571 | BE410746 | Hs. 22868 | protein tyrosine phosphatase, non-receptor type 11 | 4.0 |
| 446190 | AI279299 | Hs. 256564 | ESTs | 4.0 |
| 443542 | AI927065 | Hs. 146040 | ESTs | 4.0 |
| 430444 | AW296421 | Hs. 121035 | ESTs | 4.0 |
| 454573 | BE146471 | | gb: QV0-HT0216-011199-043-c09 HT0216 Homo sapie | 4.0 |
| 409846 | AW501748 | | gb: UI-HF-BR0p-ajm-b-12-0-UI r1 NIH_MGC_52 Hom | 4.0 |
| 456141 | AI751357 | Hs. 288741 | *Homo sapiens* cDNA: FLJ22256 fis, clone HRC02860 | 4.0 |
| 456140 | AA169515 | Hs. 6006 | ESTs | 4.0 |
| 441685 | AI459261 | Hs. 144481 | ESTs | 4.0 |
| 416677 | T83470 | | gb: yd46g06 r1 Soares fetal liver spleen 1NFLS Homo s | 4.0 |
| 401740 | | | predicted exon | 4.0 |
| 420122 | AA255714 | Hs. 284153 | Fanconi anemia, complementation group A | 4.0 |
| 442594 | AW272467 | Hs. 254655 | Untitled | 3.9 |
| 426294 | AA374185 | | gb: EST86289 HSC172 cells I *Homo sapiens* cDNA 5' e | 3.9 |
| 411922 | AW876260 | | gb: PM4-PT0019-131299-006-E04 PT0019 Homo sapie | 3.9 |
| 452320 | AA042873 | Hs. 160412 | ESTs | 3.9 |
| 431644 | AW972822 | Hs. 169248 | cytochrome c | 3.9 |
| 409892 | AW956113 | | gb: EST368183 MAGE resequences, MAGD Homo sap | 3.9 |
| 418132 | T92670 | Hs. 117421 | ESTs | 3.9 |
| 414372 | AA143654 | | gb: zo65a02 r1 Stratagene pancreas (937208) Homo sap | 3.9 |
| 400196 | | | predicted exon | 3.9 |
| 416900 | M59964 | Hs. 1048 | KIT ligand | 3.9 |
| 445444 | AA380876 | Hs. 270 | pleckstrin homology, Sec7 and coiled/coil domains, bind | 3.9 |
| 435957 | N39015 | Hs. 190368 | ESTs | 3.9 |
| 442299 | AW467791 | Hs. 155561 | ESTs | 3.9 |
| 419499 | AA808136 | Hs. 177698 | ESTs | 3.9 |
| 438403 | AA806607 | Hs. 292206 | ESTs | 3.9 |
| 449386 | AA001308 | Hs. 193213 | ESTs | 3.9 |
| 443283 | BE568610 | | gb: 601342622F1 NIH_MGC_53 *Homo sapiens* cDNA | 3.9 |
| 406481 | | | predicted exon | 3.9 |
| 453530 | AW021633 | | gb: df26c02.y1 Morton Fetal Cochlea *Homo sapiens* cDN | 3.9 |
| 415558 | AA885143 | Hs. 125719 | ESTs | 3.9 |
| 416874 | H98752 | Hs. 42568 | ESTs | 3.9 |
| 454885 | AW836922 | | gb: QV1-LT0036-150200-074-h06 LT0036 Homo sapie | 3.9 |
| 419896 | Z99362 | | gb: HSZ99362 DKFZphamy1 *Homo sapiens* cDNA clon | 3.9 |
| 440962 | AI989961 | Hs. 233477 | ESTs, Moderately similar to A Chain A, Secypa Compl | 3.9 |
| 419401 | AW804663 | | gb: QV4-UM0094-160300-135-d06 UM0094 Homo sap | 3.9 |
| 406562 | | | predicted exon | 3.8 |
| 405690 | BE409855 | Hs. 808 | heterogeneous nuclear ribonucleoprotein F | 3.8 |
| 435282 | AA677428 | Hs. 189731 | ESTs | 3.8 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 402451 | | | predicted exon | 3.8 |
| 451577 | N69101 | Hs. 32703 | ESTs | 3.8 |
| 457141 | AA521410 | Hs. 41371 | ESTs | 3.8 |
| 407817 | H92553 | Hs. 40400 | ESTs | 3.8 |
| 412613 | AA653507 | Hs. 285711 | Homo sapiens cDNA FLJ13089 fis, clone NT2RP30021 | 3.8 |
| 418355 | L42563 | Hs. 1165 | ATPase, H+/K+ transporting, nongastric, alpha polypep | 3.8 |
| 446357 | AW161533 | Hs. 300866 | ESTs | 3.8 |
| 407448 | AJ001865 | | gb: Homo sapiens mRNA, partial cDNA sequence for h | 3.8 |
| 456383 | AI148037 | | gb: qg61e01.r1 Soares_testis_NHT Homo sapiens cDNA | 3.8 |
| 444651 | W58469 | Hs. 103120 | ESTs | 3.8 |
| 455067 | AW854538 | | gb: RC3-CT0255-200100-024-b02 CT0255 Homo sapie | 3.8 |
| 442657 | BE502631 | Hs. 130645 | ESTs | 3.8 |
| 429142 | AA835639 | Hs. 104972 | ESTs | 3.8 |
| 429274 | AI379772 | Hs. 99206 | ESTs | 3.8 |
| 437774 | AW978199 | Hs. 291648 | ESTs | 3.8 |
| 427737 | AA435988 | Hs. 178066 | ESTs, Weakly similar to AF068289 5 HDCME31 P [H. s | 3.8 |
| 405671 | | | predicted exon | 3.8 |
| 413627 | BE182082 | Hs. 246973 | ESTs | 3.8 |
| 438858 | R37529 | Hs. 269924 | ESTs | 3.8 |
| 416612 | H70565 | | gb: yr97c04.r1 Soares fetal liver spleen 1NFLS Homo sa | 3.8 |
| 423045 | AW967472 | Hs. 301511 | ESTs, Highly similar to KPT2_HUMAN SERINE/THR | 3.8 |
| 453361 | AA035197 | Hs. 107375 | ESTs | 3.7 |
| 437243 | AA747549 | Hs. 259122 | ESTs | 3.7 |
| 437987 | AW450202 | Hs. 122963 | ESTs | 3.7 |
| 408781 | BE148621 | Hs. 254602 | ESTs | 3.7 |
| 455895 | BE154837 | | gb: PM1-HT0345-121199-001-c08 HT0345 Homo sapie | 3.7 |
| 431492 | AW612343 | | gb: hg97c10.x1 NCI_CGAP_Kid11 Homo sapiens cDN | 3.7 |
| 413247 | AW963969 | | gb: EST376042 MAGE resequences, MAGH Homo sap | 3.7 |
| 422866 | NM_002410 | Hs. 121502 | mannosyl (alpha-1,6-)-glycoprotein beta-1,6-N-acetyl-g | 3.7 |
| 431828 | AA572994 | | gb: nm33f12 s1 NCI_CGAP_Lip2 Homo sapiens cDNA | 3.7 |
| 438872 | R64197 | Hs. 23589 | ESTs | 3.7 |
| 438673 | AI824717 | Hs. 123443 | ESTs | 3.7 |
| 416624 | H69044 | | gb: yr77h05 s1 Soares fetal liver spleen 1NFLS Homo sa | 3.7 |
| 401963 | | | predicted exon | 3.7 |
| 402867 | | | predicted exon | 3.7 |
| 408315 | AW179148 | | gb: MR4-ST0067-200899-002-B07 ST0067 Homo sapie | 3.7 |
| 418320 | D86981 | Hs. 84084 | amyloid beta precursor protein (cytoplasmic tail)-bindin | 3.7 |
| 447199 | AI939421 | Hs. 160900 | ESTs | 3.7 |
| 422590 | AA312758 | Hs. 193945 | Homo sapiens cDNA FLJ13962 fis, clone Y79AA10012 | 3.7 |
| 451996 | AW514021 | Hs. 245510 | ESTs | 3.7 |
| 412463 | AW953444 | Hs. 78672 | laminin, alpha 4 | 3.7 |
| 440928 | AL046575 | Hs. 130198 | ESTs | 3.7 |
| 441951 | W31002 | Hs. 128195 | ESTs | 3.7 |
| 440705 | AA904244 | Hs. 153205 | ESTs | 3.7 |
| 434231 | AF119901 | Hs. 250568 | hypothetical protein PRO2831 | 3.7 |
| 411039 | AL135674 | Hs. 163348 | ESTs | 3.7 |
| 413137 | BE066915 | | gb: PM0-BT0340-231199-001-b07 BT0340 Homo sapie | 3.7 |
| 417970 | AA309234 | Hs. 57760 | Homo sapiens cDNA: FLJ23119 fis, clone LNG07978 | 3.7 |
| 439786 | AV652707 | Hs. 33756 | Homo sapiens mRNA full length insert cDNA clone EU | 3.7 |
| 459595 | AL040421 | | gb: DKFZp434B0714_r1 434 (synonym htes3) Homo s | 3.7 |
| 443601 | AI078554 | Hs. 15682 | ESTs | 3.7 |
| 404041 | | | predicted exon | 3.6 |
| 406122 | | | predicted exon | 3.6 |
| 404582 | | | predicted exon | 3.6 |
| 455786 | BE090077 | | gb: RC6-BT0710-300300-021-F02 BT0710 Homo sapie | 3.6 |
| 411899 | AA370573 | | gb: EST82238 Prostate gland I Homo sapiens cDNA 5' e | 3.6 |
| 426758 | AL036430 | Hs. 197772 | ESTs | 3.6 |
| 421776 | AW301994 | Hs. 108183 | candidate tumor suppressor p33 ING1 homolog | 3.6 |
| 430169 | AA468531 | Hs. 189047 | ESTs | 3.6 |
| 407695 | AI808007 | Hs. 66450 | ESTs | 3.6 |
| 454564 | AW807573 | | gb: MR1-ST0088-021299-004-g01 ST0088 Homo sapie | 3.6 |
| 425902 | X52509 | Hs. 161640 | tyrosine aminotransferase | 3.6 |
| 439328 | W07411 | Hs. 118212 | ESTs, Moderately similar to ALU3_HUMAN_ALU SU | 3.6 |
| 429066 | AA868555 | Hs. 178222 | ESTs | 3.6 |
| 428690 | AI948490 | Hs. 98765 | ESTs | 3.6 |
| 437302 | AA837146 | Hs. 180275 | ESTs | 3.6 |
| 443973 | AI580083 | Hs. 176154 | ESTs | 3.6 |
| 453993 | AW615224 | Hs. 252839 | ESTs | 3.6 |
| 413623 | AA825721 | Hs. 246973 | ESTs | 3.6 |
| 409196 | NM_001874 | Hs. 169765 | carboxypeptidase M | 3.6 |
| 424916 | AW867440 | Hs. 23096 | ESTs | 3.6 |
| 424769 | H06469 | Hs. 142653 | ret finger protein | 3.6 |
| 400080 | | | predicted exon | 3.6 |
| 421521 | AI638760 | Hs. 161795 | ESTs | 3.6 |
| 405549 | | | predicted exon | 3.6 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 446114 | AI275715 | Hs. 145926 | ESTs | 3.6 |
| 441392 | AW451831 | Hs. 222119 | ESTs, Weakly similar to K1CQ_HUMAN KERATIN, T | 3.6 |
| 424025 | AI701852 | Hs. 301296 | ESTs | 3.5 |
| 448527 | AI525606 | | gb: PT1 3_03_G05 r tumor 1 *Homo sapiens* cDNA 5', mR | 3.5 |
| 437063 | AA351109 | Hs. 5437 | Tax1 (human T-cell leukemia virus type I) binding prot | 3.5 |
| 449880 | AI673006 | Hs. 231948 | ESTs, Weakly similar to ALUB_HUMAN !!!! ALU CL | 3.5 |
| 449311 | AI657014 | | gb: tt49a12.x1 NCI_CGAP_GC6 *Homo sapiens* cDNA c | 3.5 |
| 442999 | AW662889 | Hs. 132395 | ESTs | 3.5 |
| 416238 | W90448 | | gb: zh78c08 s1 Soares_fetal_liver_spleen_1NFLS_S1 H | 3.5 |
| 423209 | BE278528 | Hs. 106823 | *H. sapiens* gene from PAC 426I6, similar to syntaxin 7 | 3.5 |
| 409854 | AW501833 | | gb: UI-HF-BR0p-ajo-d-01-0-UI r1 NIH_MGC_52 Hom | 3.5 |
| 414941 | C14865 | Hs. 182159 | ESTs | 3.5 |
| 456337 | AW751661 | Hs. 65919 | ESTs | 3.5 |
| 415296 | F05086 | | gb: HSC01A011 normalized infant brain cDNA Homo s | 3.5 |
| 423338 | AB007961 | Hs. 127338 | KIAA0492 protein | 3.5 |
| 415618 | F12954 | | gb: HSC3GG091 normalized infant brain cDNA Homo s | 3.5 |
| 405583 | | | predicted exon | 3.5 |
| 435601 | AF217509 | Hs. 283077 | centrosomal P4 1-associated protein, uncharacterized bo | 3.5 |
| 450867 | AA011454 | Hs. 245122 | ESTs | 3.5 |
| 431339 | AA506294 | Hs. 257266 | ESTs | 3.5 |
| 441969 | AI733386 | Hs. 129194 | ESTs, Weakly similar to ALU1_HUMAN_ALU SUBFA | 3.5 |
| 431343 | AW970603 | Hs. 300941 | *Homo sapiens* cDNA FLJ11661 fis, clone HEMBA100 | 3.5 |
| 434317 | AI674095 | Hs. 116323 | ESTs | 3.5 |
| 414741 | R51321 | Hs. 25780 | *Homo sapiens* cDNA FLJ12252 fis, clone MAMMA10 | 3.5 |
| 439707 | AW297702 | Hs. 102915 | ESTs | 3.5 |
| 443178 | AI631241 | Hs. 47312 | ESTs | 3.5 |
| 400397 | AJ270770 | Hs. 154485 | transcription factor 7-like 2 (T-cell specific, HMG-box) | 3.5 |
| 455887 | BE154173 | | gb: PM1-HT0340-201299-004-f12 HT0340 Homo sapie | 3.5 |
| 434362 | W27081 | Hs. 295446 | ESTs | 3.5 |
| 409211 | AA078835 | | gb: zm94h04.s1 Stratagene colon HT29 (937221) Homo | 3.5 |
| 414390 | BE281040 | | gb: 601156234F1 NIH_MGC_21 *Homo sapiens* cDNA | 3.5 |
| 457142 | AI924353 | Hs. 290969 | EST | 3.5 |
| 423006 | U29700 | Hs. 123014 | anti-Mullerian hormone receptor, type II | 3.5 |
| 453363 | AI989776 | Hs. 232623 | ESTs | 3.5 |
| 418913 | BE046745 | | gb: hn39b06.x1 NCI_CGAP_RDF2 *Homo sapiens* cDN | 3.4 |
| 440016 | AW118114 | Hs. 137057 | ESTs | 3.4 |
| 405096 | | | predicted exon | 3.4 |
| 435072 | AW592176 | Hs. 116932 | ESTs | 3.4 |
| 438535 | L09078 | | gb: *Homo sapiens* mRNA fragment | 3.4 |
| 424001 | W67883 | Hs. 137476 | KIAA1051 protein | 3.4 |
| 428361 | NM_015905 | Hs. 183858 | transcription intermediary factor 1 | 3.4 |
| 410587 | AA370706 | Hs. 11252 | ESTs, Weakly similar to Weak similarity with the Ysy6 | 3.4 |
| 454543 | AW806895 | | gb: QV4-ST0023-160400-172-c06 ST0023 Homo sapien | 3.4 |
| 419515 | S81944 | Hs. 90791 | gamma-aminobutyric acid (GABA) A receptor, alpha 6 | 3.4 |
| 410280 | AA083558 | Hs. 261286 | ESTs | 3.4 |
| 425714 | AW963278 | | gb: EST375351 MAGE resequences, MAGH Homo sap | 3.4 |
| 416895 | AW961600 | | gb: EST373672 MAGE resequences, MAGG Homo sap | 3.4 |
| 427935 | AW503687 | Hs. 119424 | ESTs, Weakly similar to unnamed protein product [H. sa | 3.4 |
| 411673 | BE064863 | | gb: RC1-BT0313-110300-015-f06 BT0313 Homo sapien | 3.4 |
| 453399 | AW992599 | Hs. 252797 | ESTs | 3.4 |
| 424696 | BE439547 | Hs. 151903 | *Homo sapiens* clone 24706 mRNA sequence | 3.4 |
| 436242 | AK002187 | | gb: *Homo sapiens* cDNA FLJ11325 fis, clone PLACE10 | 3.4 |
| 442837 | AI022082 | Hs. 50492 | ESTs | 3.4 |
| 452807 | AA028933 | Hs. 162434 | ESTs | 3.4 |
| 418110 | R43523 | Hs. 217754 | *Homo sapiens* cDNA FLJ22202 fis, clone HRC01333 | 3.4 |
| 433936 | AI208072 | Hs. 123459 | ESTs | 3.4 |
| 458177 | AI744995 | Hs. 267072 | ESTs, Moderately similar to ALU4_HUMAN ALU SU | 3.4 |
| 401896 | | | predicted exon | 3.4 |
| 406237 | | | predicted exon | 3.4 |
| 457688 | AL110157 | Hs. 3843 | *Homo sapiens* mRNA, cDNA DKFZp586F2224 (from | 3.4 |
| 456914 | AW363582 | Hs. 75323 | prohibitin | 3.4 |
| 421916 | R34441 | Hs. 101007 | *Homo sapiens* cDNA FLJ23546 fis, clone LNG08361 | 3.4 |
| 419321 | N48146 | Hs. 269069 | ESTs | 3.4 |
| 447876 | AV654978 | Hs. 19904 | cystathionase (cystathionine gamma-lyase) | 3.4 |
| 406197 | | | predicted exon | 3.4 |
| 443005 | AI027184 | Hs. 200918 | ESTs | 3.4 |
| 450078 | AI681743 | | gb: tx38g10.x1 NCI_CGAP_Lu24 *Homo sapiens* cDNA | 3.4 |
| 431301 | AA502384 | Hs. 151529 | ESTs | 3.4 |
| 430202 | T85775 | | gb: yd60g02 r1 Soares fetal liver spleen 1NFLS Homo s | 3.4 |
| 428559 | H24338 | Hs. 27041 | ESTs | 3.4 |
| 455731 | BE072188 | | gb: QV4-BT0536-211299-055-b09 BT0536 Homo sapie | 3.4 |
| 420735 | AW297440 | Hs. 88653 | ESTs | 3.4 |
| 430881 | NM_000809 | Hs. 248112 | gamma-aminobutyric acid (GABA) A receptor, alpha 4 | 3.3 |
| 405836 | | | predicted exon | 3.3 |
| 449178 | AI633748 | Hs. 197597 | ESTs | 3.3 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 453265 | U61232 | Hs. 32675 | tubulin-specific chaperone e | 3.3 |
| 430700 | AA768902 | Hs. 247812 | H2A histone family, member K, pseudogene | 3.3 |
| 424496 | AI733451 | Hs. 129212 | ESTs | 3.3 |
| 446963 | AI862668 | Hs. 176333 | ESTs | 3.3 |
| 422879 | AI241409 | Hs. 188092 | ESTs | 3.3 |
| 419831 | AW448930 | Hs. 5415 | ESTs | 3.3 |
| 449570 | AA001793 | | gb: zh86c06.r1 Soares_fetal_liver_spleen_1NFLS_S1 H | 3.3 |
| 406255 | | | predicted exon | 3.3 |
| 412319 | AW936903 | | gb: RC1-DT0029-030200-012-d02 DT0029 Homo sapie | 3.3 |
| 401350 | | | predicted exon | 3.3 |
| 439098 | AF085955 | | gb: *Homo sapiens* full length insert cDNA clone YR86G | 3.3 |
| 450589 | AI701505 | Hs. 202526 | ESTs | 3.3 |
| 430749 | AJ242956 | Hs. 25960 | v-myc avian myelocytomatosis viral related oncogene, n | 3.3 |
| 430689 | AI695595 | Hs. 293219 | ESTs | 3.3 |
| 454753 | AW819212 | | gb: CM1-ST0283-071299-061-c07 ST0283 Homo sapie | 3.3 |
| 444479 | AA194980 | Hs. 30818 | *Homo sapiens* cDNA FLJ13681 fis, clone PLACE20000 | 3.3 |
| 413516 | BE145907 | | gb: MR0-HT0208-221299-204-e12 HT0208 Homo sapie | 3.3 |
| 425541 | AA359119 | | gb: EST68172 Fetal lung II *Homo sapiens* cDNA 5' end, | 3.3 |
| 457107 | AA418246 | Hs. 185796 | ESTs, Weakly similar to b34I8 1 [*H. sapiens*] | 3.3 |
| 421480 | NM_016158 | Hs. 104671 | erythrocyte transmembrane protein | 3.3 |
| 444289 | BE267060 | Hs. 76391 | myxovirus (influenza) resistance 1, homolog of murine | 3.3 |
| 417725 | R25257 | Hs. 21503 | ESTs | 3.3 |
| 453631 | AL046418 | | gb: DKFZp434N247_r1 434 (synonym htes3) Homo sa | 3.3 |
| 450692 | H50603 | Hs. 94037 | hypothetical protein FLJ23053 | 3.3 |
| 413357 | W47611 | | gb: zc35e06 r1 Soares_senescent_fibroblasts_NbHSF H | 3.3 |
| 415327 | H22769 | Hs. 1861 | membrane protein, palmitoylated 1 (55 kD) | 3.3 |
| 457569 | AW970021 | Hs. 291120 | ESTs, Weakly similar to ALU8_HUMAN ALU SUBFA | 3.3 |
| 448601 | R61666 | Hs. 293690 | ESTs | 3.3 |
| 436526 | AW993633 | Hs. 287681 | *Homo sapiens* cDNA: FLJ21685 fis, clone COL09372 | 3.3 |
| 440589 | BE397763 | Hs. 194478 | *Homo sapiens* mRNA, cDNA DKFZp434O1572 (from | 3.3 |
| 418768 | T39310 | Hs. 1139 | cold shock domain protein A | 3.3 |
| 426768 | AW303337 | Hs. 270411 | ESTs | 3.3 |
| 400394 | AF040257 | Hs. 283818 | *Homo sapiens* TNF receptor homolog mRNA, partial cd | 3.3 |
| 433565 | AA599763 | Hs. 112520 | ESTs | 3.3 |
| 424093 | AA335025 | | gb: EST39621 Epididymus *Homo sapiens* cDNA 5' end, | 3.3 |
| 449552 | AA001742 | Hs. 83722 | ESTs | 3.3 |
| 431892 | AA521315 | Hs. 194424 | ESTs | 3.3 |
| 405512 | | | predicted exon | 3.3 |
| 446990 | AI354717 | Hs. 223908 | ESTs | 3.3 |
| 457729 | AI821863 | Hs. 293467 | ESTs, Weakly similar to ALU7_HUMAN ALU SUBFA | 3.2 |
| 417333 | AL157545 | Hs. 42179 | bromodomain and PHD finger containing, 3 | 3.2 |
| 456420 | AW401361 | Hs. 91773 | protein phosphatase 2 (formerly 2A), catalytic subunit, | 3.2 |
| 403497 | | | predicted exon | 3.2 |
| 427145 | R52635 | Hs. 25935 | ESTs | 3.2 |
| 406454 | | | predicted exon | 3.2 |
| 441033 | BE562555 | | gb: 601335867F1 NIH_MGC_44 *Homo sapiens* cDNA | 3.2 |
| 408444 | AW661839 | Hs. 253204 | ESTs | 3.2 |
| 434739 | AA804487 | Hs. 144130 | ESTs | 3.2 |
| 437060 | AA745591 | Hs. 292063 | ESTs | 3.2 |
| 423092 | BE274837 | Hs. 123637 | putative homeodomain transcription factor | 3.2 |
| 424695 | U58331 | Hs. 151899 | sarcoglycan, delta (35 kD dystrophin-associated glycopr | 3.2 |
| 443362 | AI053464 | Hs. 166505 | ESTs | 3.2 |
| 437500 | AL390150 | | gb: *Homo sapiens* mRNA; cDNA DKFZp547L156 (from | 3.2 |
| 425458 | H89317 | Hs. 182889 | ESTs | 3.2 |
| 439171 | AA831133 | Hs. 294128 | ESTs | 3.2 |
| 407647 | AW860158 | | gb: RC0-CT0379-290100-032-b04 CT0379 Homo sapie | 3.2 |
| 435608 | AW183971 | Hs. 250896 | ESTs | 3.2 |
| 426743 | AA383833 | Hs. 245022 | ESTs | 3.2 |
| 457525 | AW973800 | | gb: EST385901 MAGE resequences, MAGM Homo sap | 3.2 |
| 413800 | AI129238 | Hs. 192235 | ESTs | 3.2 |
| 414193 | BE260069 | | gb: 601150964F1 NIH_MGC_19 *Homo sapiens* cDNA | 3.2 |
| 455565 | BE000537 | | gb: RC3-BN0072-240200-011-d07 BN0072 Homo sapie | 3.2 |
| 410061 | T91029 | Hs. 15069 | ESTs | 3.2 |
| 450666 | T99968 | Hs. 18799 | ESTs | 3.2 |
| 458529 | AV652120 | Hs. 213232 | ESTs | 3.2 |
| 424751 | AA769482 | Hs. 296320 | ESTs | 3.2 |
| 442225 | AI306597 | Hs. 129192 | ESTs | 3.2 |
| 410990 | AW812929 | | gb: RC3-ST0186-250200-018-c05 ST0186 Homo sapien | 3.2 |
| 435644 | AA700867 | Hs. 269659 | ESTs | 3.2 |
| 405347 | | | predicted exon | 3.2 |
| 441202 | AI632143 | Hs. 135853 | ESTs | 3.2 |
| 446694 | AV659942 | Hs. 258132 | ESTs | 3.2 |
| 454652 | AW812088 | | gb: RC4-ST0173-191099-032-a07 ST0173 Homo sapien | 3.2 |
| 418985 | AI042330 | Hs. 87128 | ESTs, Weakly similar to similar to YBS4 YEAST [C. el | 3.2 |
| 430118 | AI377255 | Hs. 183287 | ESTs | 3.2 |

TABLE 5A-continued

685 DOWN-REGULATED GENES, OVARIAN CANCER VERSUS NORMAL OVARY

| Pkey | Ex. Accn | UG ID | Title | ratio |
|---|---|---|---|---|
| 430691 | C14187 | Hs. 103538 | ESTs | 3.2 |
| 416313 | H47206 | Hs. 194109 | ESTs, Weakly similar to ALUB_HUMAN !!!! ALU CL | 3.2 |
| 446122 | AI362790 | Hs. 181801 | ESTs | 3.2 |
| 453725 | W28543 | | gb: 48c5 Human retina cDNA randomly primed sublibra | 3.2 |
| 453954 | AW118336 | Hs. 75251 | DEAD/H (Asp-Glu-Ala-Asp/His) box binding protein 1 | 3.2 |
| 428166 | AA423849 | Hs. 79530 | M5-14 protein | 3.2 |
| 447506 | R78778 | Hs. 29808 | *Homo sapiens* cDNA FLJ21122 fis, clone CAS05917 | 3.2 |
| 401871 | | | predicted exon | 3.2 |
| 442160 | AI337127 | Hs. 156325 | ESTs | 3.2 |
| 404708 | | | predicted exon | 3.1 |
| 412588 | AW993055 | Hs. 44024 | ESTs | 3.1 |
| 431976 | AA719001 | Hs. 291065 | ESTs | 3.1 |
| 408884 | AW891024 | Hs. 281172 | ESTs | 3.1 |
| 433811 | AW975015 | Hs. 123138 | ESTs | 3.1 |
| 431691 | AI208511 | Hs. 292510 | ESTs | 3.1 |
| 418719 | AW975590 | Hs. 161707 | ESTs | 3.1 |
| 431740 | N75450 | Hs. 183412 | ESTs, Moderately similar to AF116721 67 PRO1777 [H. | 3.1 |
| 435699 | AI911488 | Hs. 213724 | ESTs | 3.1 |
| 459344 | AW499533 | Hs. 257976 | ESTs | 3.1 |
| 431729 | AW004714 | Hs. 162033 | ESTs | 3.1 |
| 436771 | AW975687 | Hs. 292979 | ESTs | 3.1 |
| 434480 | AW956268 | Hs. 59395 | *Homo sapiens* clone IMAGE 112574 mRNA sequence | 3.1 |
| 459547 | AI400579 | Hs. 225186 | EST | 3.1 |
| 427962 | AA946582 | Hs. 133546 | *Homo sapiens* cDNA FLJ21120 fis, clone CAS05691 | 3.1 |
| 403743 | | | predicted exon | 3.1 |
| 413560 | BE148411 | | gb: MR0-HT0241-131299-002-f04 HT0241 Homo sapie | 3.1 |
| 454372 | H96643 | Hs. 283565 | FOS-like antigen-1 | 3.1 |
| 450018 | AA421642 | Hs. 24309 | hypothetical protein FLJ11106 | 3.1 |
| 428839 | AI767756 | Hs. 82302 | ESTs | 3.1 |
| 407110 | AA018042 | Hs. 95078 | ESTs | 3.1 |
| 436133 | T77531 | Hs. 191124 | ESTs | 3.1 |
| 418872 | R94785 | Hs. 270263 | ESTs | 3.1 |
| 404418 | | | predicted exon | 3.1 |
| 446877 | AI559472 | Hs. 270720 | ESTs | 3.1 |
| 429053 | AA443967 | Hs. 194114 | ESTs | 3.1 |
| 425189 | H16622 | | gb: ym26c07.r1 Soares infant brain 1NIB Homo sapiens | 3.1 |
| 404134 | | | predicted exon | 3.1 |
| 441404 | AI638880 | Hs. 126895 | ESTs | 3.1 |
| 400076 | | | predicted exon | 3.1 |
| 411876 | AW961336 | Hs. 69705 | ESTs, Weakly similar to KIAA0443 [*H. sapiens*] | 3.1 |
| 451048 | AA013349 | Hs. 60602 | ESTs | 3.1 |
| 447021 | AI356564 | Hs. 161406 | ESTs | 3.1 |
| 404083 | | | predicted exon | 3.0 |
| 415833 | H05175 | Hs. 107510 | ESTs | 3.0 |
| 402142 | | | predicted exon | 3.0 |
| 415820 | R53720 | Hs. 189745 | ESTs | 3.0 |
| 441140 | AW016534 | Hs. 226994 | ESTs | 3.0 |
| 449376 | AA001278 | Hs. 59905 | ESTs | 3.0 |
| 457593 | AI738815 | Hs. 117323 | ESTs | 3.0 |
| 411542 | AW850767 | | gb: IL3-CT0220-031199-025-A05 CT0220 Homo sapien | 3.0 |
| 403375 | | | predicted exon | 3.0 |
| 449561 | AI022240 | Hs. 17924 | ESTs | 3.0 |
| 406241 | | | predicted exon | 3.0 |
| 420306 | AA258318 | Hs. 219226 | ESTs | 3.0 |
| 413161 | BE068130 | | gb: CM2-BT0368-171299-056-a01 BT0368 Homo sapie | 3.0 |
| 448221 | BE622615 | | gb: 601440775T1 NIH_MGC_72 *Homo sapiens* cDNA | 3.0 |
| 415920 | Z45684 | | gb: HSCZRD121 normalized infant brain cDNA Homo | 3.0 |
| 459135 | AI902802 | | gb: RC-BT015-311298-026 BT015 *Homo sapiens* cDNA | 3.0 |
| 425357 | AA355842 | | gb: EST64303 Jurkat T-cells VI *Homo sapiens* cDNA 5' | 3.0 |
| 454724 | AA091228 | | gb: cchn2152 seq F Human fetal heart, Lambda ZAP Ex | 3.0 |
| 429395 | AK002071 | Hs. 201624 | hypothetical protein FLJ11209 | 3.0 |
| 427607 | AA406119 | Hs. 270479 | ESTs | 3.0 |
| 443598 | AW499970 | Hs. 14822 | ESTs | 3.0 |
| 437948 | AA772920 | | gb: ae73c09 s1 Stratagene schizo brain S11 Homo sapien | 3.0 |
| 418105 | AW937488 | Hs. 178000 | ESTs | 3.0 |
| 426763 | AL042262 | Hs. 172101 | Human DNA sequence from clone RP1-202121 on chro | 3.0 |
| 403473 | | | predicted exon | 3.0 |
| 427501 | AI369280 | Hs. 131743 | ESTs | 3.0 |
| 453246 | NM_000933 | Hs. 32539 | KIAA1264 protein | 3.0 |
| 404587 | M99587 | Hs. 104134 | homeo box (H6 family) 1 | 3.0 |
| 433964 | AW241987 | Hs. 197025 | ESTs | 3.0 |
| 453472 | AL037925 | | gb: DKFZp564MO37_r1 564 (synonym: hfbr2) Homo sa | 3.0 |
| 433183 | AF231338 | Hs. 222024 | transcription factor BMAL2 | 3.0 |
| 435899 | W89093 | Hs. 189914 | ESTs | 3.0 |
| 425626 | AI537536 | Hs. 173519 | ESTs | 3.0 |

TABLE 5A-continued

685 DOWN-REGULATED GENES, OVARIAN CANCER VERSUS NORMAL OVARY

| Pkey | Ex. Accn | UG ID | Title | ratio |
| --- | --- | --- | --- | --- |
| 428931 | AA994979 | Hs. 98967 | ATPase, H(+)-transporting, lysosomal, noncatalytic acc | 3.0 |
| 426593 | AW958560 | | gb: EST370630 MAGE resequences, MAGE Homo sapi | 3.0 |
| 431899 | AA521381 | Hs. 187726 | ESTs | 3.0 |
| 422406 | AF025441 | Hs. 116206 | Opa-interacting proteins 5 | 3.0 |
| 448178 | AI479482 | Hs. 170789 | ESTs | 3.0 |
| 404227 | | | predicted exon | 3.0 |
| 440575 | AA889870 | Hs. 126006 | ESTs | 3.0 |
| 431198 | AL047634 | Hs. 231913 | ESTs | 3.0 |
| 434221 | AF119885 | Hs. 283040 | hypothetical protein PRO2543 | 3.0 |
| 459459 | AA460445 | | gb: zx66h11 r1 Soares__total__fetus__Nb2HF8__9w Homo | 3.0 |

Pkey: Primekey
Ex. Accn: Exemplar Accession
UG ID: UniGene ID
Title: UniGene Title
ratio: ration normal ovary vs tumor

TABLE 5B

| Pkey | CAT Number | Accession |
| --- | --- | --- |
| 407596 | 1003489__1 | R86913 R86901 H25352 R01370 H43764 AW044451 W21298 |
| 407647 | 1007366__1 | AW860158 AW862385 AW860159 AW862386 AW862341 AW821869 AW821893 AW062660 AW062656 |
| 408066 | 103649__1 | AA046914 AA057231 H38371 |
| 408315 | 1051132__1 | AW179148 AW179150 |
| 409211 | 110906__1 | AA078835 AA079319 AA078816 AA079026 AA122167 A111933 AA068989 AA084691 AA068999 AA069038 AA069225 AA650522 |
| 409699 | 1149033__1 | BE154650 BE154785 AW468343 BE154816 BE154667 |
| 409846 | 1156150__1 | AW501748 AW502972 AW502513 |
| 409854 | 1156229__1 | AW501833 AW502145 AW502581 |
| 409892 | 1157859__1 | AW956113 AW503580 |
| 410065 | 1174258__1 | AW812744 AW581974 AW812725 |
| 410454 | 1204154__1 | AW749041 BE066025 H85202 |
| 410495 | 1205826__1 | N95428 W24040 AW751366 H81987 |
| 410596 | 121053__1 | AA374186 AW963684 AA086107 AI491986 |
| 410667 | 1214679__1 | AW936099 AW936243 AW936097 BE162104 BE162109 AW794263 |
| 410758 | 1219899__1 | BE535988 AW801777 |
| 410890 | 1226008__1 | AW809575 BE090626 BE090617 AW936551 AW936552 AW936530 AW936550 AW936481 |
| 410990 | 1228649__1 | AW812929 AW812779 AW813088 |
| 411256 | 1236790__1 | AW834039 AW834040 AW834047 AW845410 BE003128 AW852479 |
| 411279 | 1237516__1 | AW884776 AW935737 AW835261 AW835247 AW835246 AW835263 AW835240 AW835258 |
| 411280 | 1237585__1 | N50617 N47321 R54159 AW860545 AW835317 |
| 411337 | 1239217__1 | AW837349 AW837355 AW882717 |
| 411542 | 1249095__1 | AW850767 AW851180 AW851359 AW851223 AW851360 AW851222 AW851108 |
| 411543 | 1249127__1 | AW851248 AW851425 AW850805 AW851021 AW850905 |
| 411673 | 1253737__1 | BE064863 BE153698 AW856751 BE153820 BE064737 BE153674 BE064730 BE065062 BE153536 AW856622 BE155079 BE064651 BE153665 BE064650 BE064691 |
| 411899 | 126497__1 | AA370573 BE160501 BE160500 BE160498 BE160502 BE160497 N72424 AA096462 |
| 411922 | 1265825__1 | AW876260 AW876269 AW876340 AW876146 AW876323 AW876320 AW876171 AW876421 AW876227 AW876243 |
| 412319 | 1288602__1 | AW936903 AW936907 AW936908 AW936914 |
| 412480 | 129929__1 | BE142364 BE142341 AA112025 |
| 412732 | 1323951__1 | AW993300 N23107 R22345 |
| 413137 | 1350383__1 | BE066915 BE066942 |
| 413161 | 1351262__1 | BE068130 BE068135 BE068134 BE068183 BE068184 BE068094 |
| 413247 | 135544__1 | AW963969 AW963971 AA127651 AA376726 |
| 413357 | 1364165__1 | W47611 BE087851 |
| 413516 | 1374595__1 | BE145907 BE145796 BE145803 BE145851 BE145923 BE145812 BE145809 BE145852 BE145856 |
| 413560 | 1376621__1 | BE148411 BE148415 H59098 |
| 414193 | 1424706__-2 | BE260069 |
| 414337 | 1436706__1 | BE386606 BE275195 BE274984 |
| 414372 | 143909__1 | AA143654 AW753140 AA213770 AW970865 AA569075 AA492132 |
| 414390 | 1441570__-1 | BE281040 |
| 415296 | 1533528__1 | F05086 F05091 R17158 |
| 415618 | 1540651__1 | F12954 H10624 R11948 R56523 T75190 |
| 415920 | 1561733__1 | Z45684 H09361 R53285 |
| 416211 | 1578993__1 | R14625 R17952 H29120 R14650 |
| 416238 | 1580451__1 | W90448 H30749 |
| 416612 | 1603885__1 | H70565 N77403 H67949 |
| 416624 | 1604694__1 | H69044 T47567 H75691 T50292 |
| 416677 | 1608621__1 | T83470 T84283 H74054 |
| 416895 | 162874__1 | AW961600 AA190217 AA321260 |
| 417178 | 1655565__1 | N51636 T51874 T51829 |

TABLE 5B-continued

| Pkey | CAT Number | Accession |
|---|---|---|
| 417762 | 169750__1 | AA205976 AA205930 |
| 418913 | 180520__1 | BE046745 AI074878 AI817476 AW572513 AA447586 H28330 AA232486 AA365704 BE271167 |
| 419401 | 184454__1 | AW804663 AW805017 AA236969 |
| 419896 | 1888662__1 | Z99362 Z99363 |
| 420352 | 192979__1 | BE258835 AW968316 AA258918 AW843305 R14744 AI580388 BE071923 R36280 |
| 421418 | 202288__1 | AA806639 AA291008 AA836274 AW978806 |
| 422046 | 210744__1 | AI638562 T16929 H13401 F07773 R55836 |
| 422128 | 211994__1 | AW881145 AA490718 M85637 AA304575 T06067 AA331991 |
| 423403 | 227942__1 | AA325483 AW962169 AW962660 |
| 424093 | 235233__1 | AA335025 AA335496 AW966145 |
| 424719 | 242889__1 | H90452 AA345767 AW964302 H90399 |
| 425189 | 247825__1 | H16622 R17322 AA351959 |
| 425357 | 250578__-1 | AA355842 |
| 425541 | 252945__1 | AA359119 AW963014 D79884 |
| 425714 | 255333__1 | AW963278 AA362266 AA362267 |
| 426294 | 263994__1 | AA374185 AW956180 H38344 |
| 426528 | 268722__1 | AA380828 AW963760 AA380805 AA380830 |
| 426593 | 269748__1 | AW958560 AA382199 AW444933 |
| 430202 | 314322__1 | T85775 AW968345 AA468998 |
| 430535 | 319643__1 | AW968485 AW968670 AA480922 BE350425 |
| 431075 | 327638__1 | BE267477 AA491488 AW836723 |
| 431492 | 333930__1 | AW612343 AA922558 AA505925 AA927038 AW972537 AI693564 |
| 431828 | 338201__1 | AA572994 AA516249 AA702595 |
| 432075 | 341066__1 | AW972934 AA525260 AA525266 AA835021 BE000149 BE000148 |
| 432474 | 348197__1 | AA584042 AW973273 AA548798 |
| 433371 | 364430__1 | T25451 AA585296 AA585305 |
| 433403 | 36534__-1 | AF040247 |
| 433767 | 374014__1 | AA609245 AA724581 AW241989 AI377274 T47300 |
| 434738 | 392562__1 | AA836265 AA648266 AW974440 |
| 436196 | 41562__1 | AK001084 AA078092 AA829049 |
| 436242 | 41641__1 | AK002187 R66351 |
| 436812 | 427323__1 | AW298067 AA731645 AA810101 AW194180 AI690673 AW978773 |
| 437500 | 43772__1 | AL390150 AW959182 AA358923 |
| 437948 | 445966__1 | AA772920 D59870 D61151 AI591331 |
| 438224 | 452656__1 | AA933999 AA781181 |
| 438535 | 45946__1 | L09078 L03145 L09094 L09098 L03165 L09102 |
| 439098 | 46859__1 | AF085955 H69158 H69081 |
| 439126 | 46887__1 | AF085984 H95905 H95906 |
| 441033 | 50807__-1 | BE562555 |
| 443283 | 56492__-1 | BE568610 |
| 445597 | 644513__1 | H65649 AW753545 AI244270 |
| 445832 | 651925__1 | AI261545 N59134 AW875371 AW875247 |
| 448221 | 75534__-1 | BE622615 |
| 448527 | 766707__1 | AI525606 BE549857 |
| 448732 | 77773__-1 | BE614063 |
| 449311 | 804513__1 | AI657014 AW594035 AI657036 AI638390 |
| 449570 | 81018__1 | AA001793 AA001871 |
| 450078 | 823882__1 | AI681743 AW897287 AW897205 AW897284 |
| 452351 | 91233__1 | AA025647 R45716 AW753786 |
| 452453 | 918300__1 | AI902519 AI902518 AI902516 |
| 453472 | 968371__1 | AL037925 AL037931 AL037957 |
| 453530 | 97021__1 | AW021633 AA036730 AI866854 |
| 453631 | 975024__1 | AL046418 N52738 R33840 |
| 453725 | 978760__1 | W28543 AL119531 |
| 453752 | 979899__1 | AL120800 BE378580 |
| 453823 | 982526__1 | AL137967 BE064160 BE064186 |
| 454102 | 1011603__1 | AW752363 BE147120 N22640 |
| 454487 | 1216101__1 | AW796342 AW796356 BE161430 |
| 454543 | 1223775__1 | AW806895 AW866476 AW866465 AW866535 AW866623 |
| 454564 | 1224407__1 | AW807573 AW807566 AW807572 |
| 454673 | 1225624__1 | BE146471 AW833743 AW833609 AW821469 AW821488 AW821541 AW821531 AW821513 AW821549 AW821384 AW821625 AW821577 AW821547 AW834577 |
| 454652 | 1228071__1 | AW812088 AW812105 AW812082 |
| 454679 | 1228929__1 | AW813110 AW813113 |
| 454724 | 123128__1 | AA091228 H71860 H71073 |
| 454753 | 1233576__1 | AW819212 AW819170 BE158474 AW819172 AW819213 AW819200 AW819256 AW819254 AW819178 AW819214 AW819215 AW819233 AW819171 |
| 454885 | 1238874__1 | AW836922 AW876719 AW876688 AW836919 AW836997 AW836908 AW836912 AW836993 |
| 454940 | 1245640__1 | AW846202 AW846174 AW846532 AW846181 AW846458 AW846206 AW846432 AW846553 AW846533 AW846197 AW846198 AW846189 AW846469 AW846530 AW846560 AW846536 AW846472 AW846470 AW846466 AW846192 AW846479 AW846260 AW846204 AW846139 AW846187 AW846353 AW846462 AW846151 AW846549 AW846538 AW846527 AW846567 AW846531 |
| 454994 | 1248637__1 | AW850176 AW850513 AW850412 AW850451 |
| 455056 | 1250934__1 | AW853057 AW853039 AW853042 AW853050 AW853114 AW853105 AW853102 AW853111 AW853121 AW853109 AW853126 |
| 455067 | 1252050__1 | AW854538 AW854418 AW854412 |
| 455108 | 1253916__1 | AW856866 AW856858 AW856856 |

TABLE 5B-continued

| Pkey | CAT Number | Accession |
|---|---|---|
| 455387 | 1287871_1 | BE069037 AW936025 BE069178 AW936034 |
| 455388 | 1287904_1 | AW936234 AW936074 AW936181 AW936179 AW936217 AW936077 AW936227 AW936191 |
| 455534 | 1322942_1 | AW991925 AW991919 |
| 455565 | 1329591_1 | BE000537 BE180584 BE180540 BE180542 BE180546 |
| 455731 | 1353872_1 | BE072188 BE072299 BE072269 BE072317 BE072238 |
| 455786 | 1365510_1 | BE090077 BE090079 |
| 455790 | 1365950_1 | BE090690 BE090688 BE090681 BE090693 BE090675 |
| 455887 | 1380836_1 | BE154173 BE154098 BE154096 |
| 455895 | 1381386_1 | BE154837 BE154879 BE154850 BE154877 BE154835 BE154849 BE154902 BE154905 BE154867 BE154901 BE154904 BE154899 |
| 456253 | 1699178_1 | T12198 T19684 T11583 R15526 R15585 R45876 R15562 |
| 456383 | 184252_1 | AI148037 AA287178 AA236756 |
| 456388 | 1842839_-1 | W28557 |
| 457525 | 351732_1 | AW973800 AA557589 AA559886 |
| 457740 | 39528_1 | AW500458 AW160900 AF161362 AF150327 AW578393 AW360921 AW360920 AW360902 AW360890 AW732529 |
| 458301 | 543058_1 | AF003834 W36292 |
| 459135 | 918516_1 | AI902802 AI902783 AI902800 |
| 459157 | 919804_2 | AI904385 AI904382 |

Pkey: Unique Eos probeset idenitifier number
CAT number: Gene cluster number
Accession: Genbank accession number

TABLE 5C

| Pkey | Ref | Strand | Nt_position |
|---|---|---|---|
| 400942 | 7656749 | Minus | 91593–91757, 92720–92843, 93962–94079, 94824–94997 |
| 401004 | 7229982 | Plus | 62580–62772 |
| 401287 | 9801612 | Minus | 42287–42431 |
| 401308 | 9212516 | Plus | 169019–169649 |
| 401350 | 9931226 | Plus | 14471–14623 |
| 401740 | 2982169 | Plus | 148357–148484, 148591–148690 |
| 401871 | 8079355 | Minus | 58158–59585 |
| 401896 | 8569194 | Plus | 115129–115294 |
| 401963 | 3126783 | Plus | 51382–51521 |
| 402105 | 8131588 | Minus | 22856–24055 |
| 402109 | 8131678 | Minus | 171722–171859, 173197–173303 |
| 402142 | 7704985 | Minus | 29932–30698 |
| 402451 | 9796677 | Minus | 48137–48343 |
| 402867 | 5596716 | Plus | 52806–53106, 53500–53818 |
| 403277 | 8072597 | Minus | 27494–27642 |
| 403283 | 8076905 | Minus | 71124–71996 |
| 403375 | 9255944 | Minus | 92554–92795 |
| 403473 | 9945095 | Minus | 54241–54437 |
| 403497 | 6067111 | Plus | 7221–7441 |
| 403531 | 8076842 | Minus | 75903–76134 |
| 403635 | 6862664 | Minus | 157028–157145, 161725–161900 |
| 403714 | 7210030 | Minus | 145556–145873 |
| 403743 | 7652003 | Minus | 136463–136646 |
| 404020 | 8655966 | Minus | 174449–174663 |
| 404041 | 8886967 | Minus | 1334–1503, 2483–2685, 5230–5337, 19656–19804 |
| 404044 | 9558573 | Minus | 225757–225939 |
| 404083 | 9944029 | Minus | 16650–17082 |
| 404108 | 8247074 | Minus | 63603–64942 |
| 404134 | 6981900 | Minus | 40633–40911 |
| 404227 | 7838233 | Minus | 93110–93259 |
| 404418 | 7382420 | Minus | 153339–153481, 155099–155294 |
| 404451 | 7638438 | Minus | 105191–105622 |
| 404582 | 9739220 | Plus | 53230–53424 |
| 404708 | 9800828 | Plus | 77522–77658 |
| 404868 | 9454593 | Plus | 39954–40430 |
| 405096 | 8072599 | Plus | 140844–140897, 148510–148581 |
| 405290 | 3900849 | Minus | 79582–79765 |
| 405347 | 2979602 | Minus | 977–1116 |
| 405512 | 9454624 | Plus | 17802–17966, 18573–18697 |
| 405549 | 1552494 | Plus | 10876–11048 |
| 405583 | 4512287 | Plus | 56211–56353 |
| 405671 | 2565031 | Plus | 25805–26923 |
| 405717 | 9588573 | Plus | 11275–11973 |
| 405752 | 9212305 | Plus | 91392–91528 |
| 405836 | 5686282 | Minus | 5031–5217 |
| 406122 | 9144087 | Minus | 30940–31386 |
| 406197 | 7289992 | Minus | 47520–47961 |

TABLE 5C-continued

| Pkey | Ref | Strand | Nt_position |
|---|---|---|---|
| 406237 | 7417725 | Plus | 30032–30501 |
| 406241 | 7417725 | Minus | 34951–35752 |
| 406255 | 7417729 | Plus | 2959–3200 |
| 406364 | 9256114 | Minus | 50715–50833 |
| 406454 | 9588380 | Minus | 91746–91958 |
| 406481 | 9864741 | Minus | 91439–91579 |
| 406562 | 7711584 | Plus | 37316–37426 |
| 406605 | 8272666 | Minus | 23275–23493, 23723–23903 |

Pkey: Unique number corresponding to an Eon probeset
Ref: Sequence source. The 7 digit numbers in this column are Genbank Identifier (Gi) numbers. "Dunham I et at," refers to the publication entitled "The DNA sequence of human chromosome 22" Dunham, et al, (1999) Nature 402: 489–495
Strand: Indicates DNA strand from which exons were predicted
Nt_position: Indicates nucteobde positions of predicted exons TABLE 6A lists about 68 genes highly down-regulated in ovarian cancer compared to normal ovaries These were selected as for Table 5A, except the "average" ovarian cancer level was set to the maximum value amongst various ovarian cancers and the "average" normal ovary level was set to the minimum value from various non-malignant ovary specimens, and the ratio was greater than or equal to 2 5 (i e 2 5-fold down-regulated in the highest tumor vs. the lowest normal ovary) This has the overall effect of increasing stringency, and reducing the number of false-positives

TABLE 6A

ABOUT 68 HIGHLY DOWN-REGULATED GENES, OVARIAN CANCER VERSUS NORMAL OVARY

| Pkey | Ex. Accn | UG ID | Title | ratio |
|---|---|---|---|---|
| 424851 | 44676441 | Hs. 119059 | ESTs | 7.9 |
| 437690 | AA804362 | Hs. 180544 | ESTs | 4.7 |
| 433682 | AA642418 | Hs. 17381 | ESTs | 4.1 |
| 407437 | AF220264 | | gb: *Homo sapiens* MOST-1 mRNA, complete cds | 4.1 |
| 437787 | AI908263 | Hs. 291625 | ESTs | 4.0 |
| 453282 | AK000043 | Hs. 32922 | hypothetical protein FLJ20036 | 4.0 |
| 440987 | AA911705 | Hs. 130229 | ESTs | 3.8 |
| 443131 | AI033833 | Hs. 132689 | ESTs | 3.8 |
| 431075 | BE267477 | | gb: 601189542F2 NIH_MGC_7 *Homo sapiens* cDNA clo | 3.6 |
| 412637 | AA115097 | Hs. 261313 | ESTs | 3.6 |
| 408141 | U69205 | Hs. 45152 | ESTs, Moderately similar to neurogenic basic-helix-loop | 3.5 |
| 420122 | AA255714 | Hs. 284153 | Fanconi anemia, complementatian group A | 3.5 |
| 430653 | AW902062 | Hs. 30280 | ESTs | 3.4 |
| 401308 | | | predicted exon | 3.4 |
| 410758 | BE535988 | | gb: 601062418F1 NIH_MGC_10 *Homo sapiens* cDNA c | 3.4 |
| 421418 | AA806639 | | gb: ob88g05 s1 NCI_CGAP_GCB1 *Homo sapiens* cDNA | 3.4 |
| 450061 | AI797034 | Hs. 201115 | ESTs | 3.3 |
| 409725 | T40760 | Hs. 90459 | EST | 3.3 |
| 434738 | 44836265 | | gb: od17e02 s1 NCI_CGAP_GCB1 *Homo sapiens* cDNA | 3.3 |
| 431644 | AW972822 | Hs. 169248 | cytochrome c | 3.3 |
| 450938 | AW753734 | Hs. 277215 | ESTs | 3.2 |
| 420497 | AW206285 | Hs. 253548 | ESTs | 3.2 |
| 439426 | AI131502 | Hs. 143135 | ESTs, Weakly similar to FAFY_HUMAN PROBABLE C | 3.2 |
| 407596 | R86913 | | gb: yq30f05 r1 Soares fetal liver spleen 1NFLS Homo sap | 3.2 |
| 448683 | AA167642 | Hs. 14632 | ESTs | 3.2 |
| 431982 | AW419296 | Hs. 105754 | ESTs | 3.1 |
| 452320 | AA042873 | Hs. 160412 | ESTs | 3.1 |
| 419401 | AW804663 | | gb: QV4-UM0094-160300-135-d06 UM0094 Homo sapim | 3.1 |
| 402105 | | | predicted exon | 3.1 |
| 444997 | AI204451 | Hs. 146196 | ESTs | 3.1 |
| 403283 | | | predicted exon | 3.0 |
| 455388 | AW936234 | | gb: QV0-DT0020-090200-106-g05 DT0020 Homo sapie | 3.0 |
| 428559 | H24338 | Hs. 27041 | ESTs | 2.9 |
| 419002 | T78625 | Hs. 268594 | ESTs | 2.9 |
| 404868 | | | predicted exon | 2.9 |
| 409090 | W56067 | Hs. 103105 | ESTs | 2.9 |
| 406605 | | | predicted exon | 2.9 |
| 441202 | AI632143 | Hs. 135853 | ESTs | 2.8 |
| 422046 | AI638562 | | gb: ts50a10.x1 NCI_CGAP_Ut1 *Homo sapiens* cDNA cl | 2.8 |
| 442865 | N57659 | Hs. 114541 | ESTs, Weakly similar to neuronal thread protein AD7c-N | 2.8 |

TABLE 6A-continued

ABOUT 68 HIGHLY DOWN-REGULATED GENES, OVARIAN CANCER VERSUS NORMAL OVARY

| Pkey | Ex. Accn | UG ID | Title | ratio |
|---|---|---|---|---|
| 444431 | AW513324 | Hs. 42280 | ESTs | 2.8 |
| 426294 | AA374185 | | gb: EST86289 HSC172 cells I *Homo sapiens* cDNA 5' en | 2.8 |
| 412480 | BE142364 | | gb: CM0-HT0143-270999-062-d12 HT0143 Homo sapie | 2.8 |
| 449858 | AW205979 | Hs. 196065 | ESTs | 2.8 |
| 401464 | AF039241 | Hs. 9028 | histone deacetylase 5 | 2.7 |
| 439126 | AF085984 | | gb: *Homo sapiens* full length insert cDNA clone YT99F0 | 2.7 |
| 403277 | | | predicted exon | 2.7 |
| 450078 | AI681743 | | gb: tx38g10.x1 NCI_CGAP_Lu24 *Homo sapiens* cDNA | 2.7 |
| 458090 | AI282149 | Hs. 56213 | ESTs, Highly similar to FXD3_HUMAN FORKHEAD D | 2.7 |
| 420620 | AA278807 | Hs. 173343 | ESTs | 2.7 |
| 459054 | AW798466 | Hs. 82396 | 2', 5'-oligoadenylate synthetase 1 | 2.6 |
| 421379 | Y15221 | Hs. 103982 | small inducible cytokine subfamily B (Cys-X-Cys), mem | 2.6 |
| 454338 | AW381251 | Hs. 1050 | pleckstrin homology, Sec7 and coiled/coil domains 1(cyt | 2.6 |
| 454529 | Z45439 | Hs. 270425 | ESTs | 2.6 |
| 446877 | AI559472 | Hs. 270720 | ESTs | 2.6 |
| 412588 | AW993055 | Hs. 44024 | ESTs | 2.6 |
| 449862 | AI672277 | Hs. 199475 | ESTs | 2.6 |
| 446694 | AV659942 | Hs. 258132 | ESTs | 2.6 |
| 424029 | AB014594 | Hs. 137579 | KIAA0694 gene product | 2.6 |
| 454102 | AW752363 | | gb: RC0-CT0201-270999-011-f03 CT0201 Homo sapien | 2.6 |
| 430922 | AW373747 | Hs. 183337 | ESTs | 2.6 |
| 420289 | N55394 | Hs. 96398 | 8-oxoguanine DNA glycosylase | 2.6 |
| 410495 | N95428 | | gb: zb80d09.s1 Soares_senescent_fibroblasts_NbHSF Ho | 2.5 |
| 412319 | AW936903 | | gb: RC1-DT0029-030200-012-d02 DT0029 Homo sapien | 2.5 |
| 409699 | BE154650 | | gb: PM3-HT0344-071299-003-c08 HT0344 Homo sapien | 2.5 |
| 445832 | AI261545 | | gb: qz30a07 x1 NCI_CGAP_Kid11 *Homo sapiens* cDNA | 2.5 |
| 429755 | NM_001364 | Hs. 215839 | discs, large (Drosophila) homolog 2 (chapsyn-110) | 2.5 |
| 445755 | AW294870 | Hs. 223672 | ESTs | 2.5 |

Pkey: Primekey
Ex. Accn: Exemplar Accession
UG ID: UniGene ID
Title: UniGene Title
ratio: ration of normal ovary vs. tumor

TABLE 6B

| Pkey | CAT Number | Accession |
|---|---|---|
| 407596 | 1003489_1 | R86913 R86901 H25352 R01370 H43764 AW044451 W21298 |
| 409699 | 1149033_1 | BE154650 BE154785 AW468343 BE154816 BE154667 |
| 410495 | 1205826_1 | N95428 W24040 AW751366 H81987 |
| 410758 | 1219899_1 | BE535988 AW801777 |
| 412319 | 1288602_1 | AW936903 AW936907 AW936908 AW936914 |
| 412480 | 129929_1 | BE142364 BE142341 AA112025 |
| 419401 | 184454_1 | AW804663 AW805017 AA236969 |
| 421418 | 202288_1 | AA806639 AA291008 AA836274 AW978806 |
| 422046 | 210744_1 | AI638562 T16929 H13401 F07773 R55836 |
| 426294 | 263994_1 | AA374185 AW956180 H38344 |
| 431075 | 327638_1 | BE267477 AA491488 AW836723 |
| 434738 | 392562_1 | AA836265 AA648266 AW974440 |
| 439126 | 46887_1 | AF085984 H95905 H95906 |
| 445832 | 651925_1 | AI261545 N59134 AW875371 AW875247 |
| 450078 | 823882_1 | AI681743 AW897287 AW897205 AW897284 |
| 454102 | 1011603_1 | AW752363 BE147120 N22640 |
| 455388 | 1287904_1 | AW936234 AW936074 AW936181 AW936179 AW936217 AW936077 AW936227 AW936191 |

Pkey: Unique Eos probeset identifier number
CAT number Gene cluster number
Accession: Genbank accession numbers

TABLE 6C

| Pkey | Ref | Strand | Nt_position |
|---|---|---|---|
| 401308 | 9212516 | Plus | 169019–169649 |
| 402105 | 8131588 | Minus | 22856–24055 |
| 403277 | 8072597 | Minus | 27494–27642 |
| 403283 | 8076905 | Minus | 71124–71996 |
| 404868 | 9454593 | Plus | 39954–40430 |
| 406605 | 8272666 | Minus | 23275–23493, 23723–23903 |

Pkey: Unique number corresponding to an Eos probeset
Ref: Sequence source. The 7 digit numbers in this column are Genbank Identifier (GI) numbers. "Dunham I et al" refers to the publication entitled "The DNA sequence of human chromosome 22" Dunham, et al (1999) Nature 402: 489–495
Strand: Indicates DNA strand from which exons were predicted
Nt_position: Indicates nucleotide positions of predicted exons Table 7A lists about 770 genes up-regulated in ovarian cancer compared to normal adult tissues These were selected from 35403 probesets on the Affymetrix/Eos-Hu01 Gene-Chip array such that the ratio of "average" ovarian cancer to "average" normal adult tissues was greater than or equal to 2 5 The "average" ovarian cancer level was set to the 2nd highest amongst various ovarian cancers. The "average" normal adult tissue level was set to the 7th highest amongst various non-malignant tissues In order to remove gene-specific background levels of non-specific hybridization, the 15th percentile value amongst the non-malignant tissues was subtracted from both the numerator and the denominator before the ratio was evaluated

TABLE 7A

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 109680 | F09255 | Hs. 4993 | ESTs | 23.2 |
| 119743 | W70242 | Hs.58086 | ESTs | 22.0 |
| 132528 | AA283006 | Hs. 50758 | chromosome-associated polypeptide C | 22.0 |
| 129571 | X51630 | Hs. 1145 | Wilms tumor 1 | 20.0 |
| 102151 | U17280 | Hs. 3132 | steroidogenic acute regulatory protein | 19.6 |
| 130941 | D49394 | Hs. 2142 | 5-hydroxytryptamine (serotonin) receptor 3A | 17.5 |
| 132624 | AA164819 | Hs. 53631 | ESTs | 15.9 |
| 102610 | U65011 | Hs. 30743 | preferentially expressed antigen in melanoma | 15.4 |
| 101249 | L33881 | Hs.1904 | protein kinase C, iota | 14.5 |
| 122802 | AA460530 | Hs. 256579 | ESTs | 14.5 |
| 135242 | M74093 | Hs. 9700 | cyclin E1 | 13.8 |
| 101804 | M86699 | Hs.169840 | TTK protein kinase | 12.2 |
| 123005 | AA479726 | Hs. 105577 | ESTs | 12.0 |
| 114965 | AA250737 | Hs. 72472 | ESTs | 11.5 |
| 115536 | AA347193 | Hs. 62180 | ESTs | 11.4 |
| 132191 | AA449431 | Hs.158688 | KIAA0741 gene product | 10.9 |
| 121853 | AA425887 | Hs.98502 | ESTs | 10.9 |
| 115881 | AA435577 | Hs. 184942 | G protein-coupled receptor 64 | 10.8 |
| 119780 | W72967 | Hs. 191381 | ESTs, Weakly similar to hypothetical protein | 10.5 |
| 104301 | D45332 | Hs.6783 | ESTs | 10.3 |
| 132632 | N59764 | Hs. 5398 | guanine-monophosphate synthetase | 10.1 |
| 105298 | AA233459 | Hs.26369 | ESTs | 9.7 |
| 108857 | AA133250 | Hs. 62180 | ESTs | 9.1 |
| 113168 | T53592 | Hs. 161586 | EST | 9.0 |
| 115892 | AA435946 | Hs. 50831 | ESTs | 8.9 |
| 125666 | AA199856 | Hs.118811 | ESTs | 8.9 |
| 102200 | U21551 | Hs. 157205 | branched chain aminotransferase 1, cytosolic | 8.8 |
| 108055 | AA043562 | Hs. 62637 | ESTs | 8.6 |
| 132572 | AA448297 | Hs.237825 | signal recognition particle 72 kD | 8.6 |
| 115909 | AA436666 | Hs. 59761 | ESTs | 8.5 |
| 109166 | AA179845 | Hs. 73625 | RAB6 interacting, kinesin-like (rabkinesin6) | 8.3 |
| 121779 | AA422036 | Hs. 98367 | ESTs | 8.3 |
| 102915 | X07820 | Hs.2258 | matrix metalloproteinase 10 (stromelysin 2) | 8.0 |
| 105317 | AA233926 | Hs.23635 | ESTs | 7.8 |
| 125250 | W87465 | Hs. 222926 | ESTs, Weakly similar to D2092 2 [C. elegans] | 7.8 |
| 126960 | AA317900 | Hs.161756 | ESTs | 7.8 |
| 122969 | AA478539 | Hs. 104336 | ESTs | 7.7 |
| 130376 | R40873 | Hs. 155174 | KIAA0432 gene product | 7.7 |
| 123339 | AA504253 | Hs. 101515 | ESTs | 7.7 |
| 134972 | M19720 | Hs. 169252 | Human L-myc protein gene, complete cds | 7.6 |
| 111234 | N69287 | Hs.21943 | ESTs, Weakly similar to ORF YGL221c [S.cerevi | 7.5 |
| 123689 | AA609556 | Hs. 256562 | ESTs | 7.5 |
| 123494 | AA599786 | Hs. 112110 | ESTs | 7.4 |
| 131985 | AA434329 | Hs. 36563 | ESTs | 7.4 |
| 106738 | AA470145 | Hs.25130 | ESTs | 7.4 |
| 108768 | AA127741 | Hs. 61345 | ESTs | 7.3 |
| 106474 | AA450212 | Hs. 42484 | *Homo sapiens* mRNA, cDNA DKFZp564C053 (from cl | 7.2 |
| 123308 | AA496211 | Hs. 103538 | ESTs | 7.2 |
| 106124 | AA423987 | Hs.7567 | ESTs | 7.2 |
| 111345 | N89820 | Hs.14559 | ESTs | 7.1 |
| 105200 | AA195399 | Hs. 24641 | ESTs | 7.1 |
| 116416 | AA609219 | Hs. 39982 | ESTs | 7.1 |
| 118846 | N80567 | Hs. 50895 | ESTs | 7.1 |
| 133434 | AA278852 | Hs. 250786 | ESTs | 7.1 |
| 120472 | AA251875 | Hs. 104472 | ESTs, Weakly similar to Gag-Pol polyprotein [ | 6.9 |
| 115291 | AA279943 | Hs.122579 | ESTs | 6.9 |
| 111185 | N67551 | Hs. 12844 | EGF-like-domain, multiple 6 | 6.9 |
| 108778 | AA128548 | Hs. 90847 | general transcription factor IIIC, polypeptid | 6.9 |
| 132939 | U76189 | Hs. 61152 | exostoses (multiple)-like 2 | 6.9 |
| 134520 | N21407 | Hs. 257325 | ESTs | 6.9 |
| 114724 | AA131701 | Hs. 256287 | ESTs, Highly similar to SPERM SURFACE PROTEIN | 6.8 |
| 116296 | AA489033 | Hs. 62601 | *Homo sapiens* mRNA, cDNA DKFZp586K1318 (from c | 6.8 |
| 102136 | U15552 | Hs. 85769 | acidic 82 kDa protein mRNA | 6.7 |
| 132725 | L41887 | Hs. 184167 | splicing factor, arginine/serine-rich 7 (35 kD | 6.5 |
| 109648 | F04600 | Hs. 7154 | ESTs | 6.4 |
| 116401 | AA599963 | Hs. 59698 | ESTs | 6.4 |
| 127563 | AI367707 | Hs.150587 | ESTs | 6.4 |
| 104252 | AF002246 | Hs.210863 | cell adhesion molecule with homology to L1CAM | 6.4 |
| 120438 | AA243441 | Hs.99488 | ESTs, Weakly similar to ORF YKR074w [S.cerevi | 6.2 |
| 131978 | D80008 | Hs. 36232 | KIAA0186 gene product | 6.2 |
| 134621 | L02547 | Hs.172865 | cleavage stimulation factor, 3' pre-RNA; subu | 6.2 |
| 120571 | AA280738 | Hs. 128679 | ESTs | 6.2 |
| 102627 | U66561 | Hs. 158174 | zinc finger protein 184 (Kruppel-like) | 6.1 |
| 100661 | HG2874-HT3018 | | Ribosomal Protein L39 Homolog | 6.1 |
| 118204 | N59859 | Hs. 48443 | ESTs | 6.0 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 131386 | AA096412 | Hs. 173135 | dual-specificity tyrosine-(Y)-phosphorylation | 6.0 |
| 129097 | S50223 | | HKR-T1=Kruppel-like zinc finger protein [huma | 5.9 |
| 131228 | AA279157 | Hs.24485 | chondroitin sulfate proteoglycan 6 (bamacan) | 5.9 |
| 106369 | AA443828 | Hs. 25324 | ESTs | 5.9 |
| 108255 | AA063157 | Hs. 172608 | ESTs | 5.8 |
| 125370 | AA256743 | Hs. 151791 | KIAA0092 gene product | 5.8 |
| 130010 | N52966 | Hs. 142838 | ESTs | 5.8 |
| 131945 | M87339 | Hs. 35120 | replication factor C (activator 1) 4 (37 kD) | 5.7 |
| 116238 | AA479362 | Hs.47144 | DKFZP586N0819 protein | 5.7 |
| 102221 | U24576 | | LIM domain only 4 | 5.6 |
| 130757 | R00641 | Hs.18925 | ESTs, Weakly similar to cDNA EST yk339a7 5 co | 5.6 |
| 131278 | U81523 | Hs.25195 | endometrial bleeding associated factor (left- | 5.6 |
| 101383 | M14113 | Hs. 79345 | coagulation factor VIIIc, procoagulant compon | 5.5 |
| 131836 | AA610086 | Hs. 32990 | DKFZP566F084 protein | 5.5 |
| 129628 | U26727 | Hs. 1174 | cyclin-dependent kinase inhibitor 2A (melanoma | 5.5 |
| 106523 | AA453441 | Hs. 31511 | ESTs | 5.5 |
| 111772 | R28287 | Hs. 237146 | ESTs | 5.5 |
| 101255 | L34600 | Hs.149894 | mitochondrial translational initiation factor | 5.5 |
| 106895 | AA489665 | Hs.25245 | ESTs | 5.5 |
| 104943 | AA065217 | Hs. 169674 | ESTs | 5.5 |
| 129229 | AA211941 | Hs. 109643 | polyadenylate binding protein-interacting pro | 5.4 |
| 102305 | U33286 | Hs. 90073 | chromosome segregation 1 (yeast homolog)-like | 5.4 |
| 106553 | AA454967 | Hs. 5887 | ESTs; Highly similar to RNA binding motif pro | 5.4 |
| 112305 | R54822 | Hs.26244 | ESTs | 5.3 |
| 123972 | C14782 | Hs. 70337 | immunoglobulin superfamily; member 4 | 5.3 |
| 102676 | U72514 | Hs. 12045 | putative protein | 5.3 |
| 106459 | AA449741 | Hs. 4029 | glioma-amplified sequence-41 | 5.2 |
| 107865 | AA025104 | Hs. 61252 | ESTs | 5.2 |
| 121121 | AA399371 | Hs. 189095 | ESTs, Weakly similar to zinc finger protein S | 5.2 |
| 127162 | N76398 | Hs. 21187 | ESTs | 5.2 |
| 131646 | AA171895 | Hs. 30057 | *Homo sapiens* clone 24749 and 24750 mRNA seque | 5.2 |
| 121770 | AA421714 | Hs. 11469 | KIAA0896 protein | 5.2 |
| 122512 | AA449311 | Hs.98658 | budding uninhibited by benzimidazoles 1 (yeas | 5.1 |
| 105870 | AA399623 | Hs. 23505 | ESTs | 5.1 |
| 100341 | D63506 | Hs. 8813 | syntaxin binding protein 3 | 5.1 |
| 116848 | H65187 | Hs. 39001 | ESTs | 5.1 |
| 120821 | AA347419 | Hs. 96870 | *Homo sapiens* mRNA full length insert cDNA clo | 5.1 |
| 130690 | AA084286 | Hs.139033 | paternally expressed gene 3 | 5.1 |
| 122661 | AA454936 | Hs. 245541 | ESTs | 5.1 |
| 123169 | AA488892 | Hs. 104472 | ESTs, Weakly similar to Gag-Pol polyprotein [ | 5.1 |
| 108810 | AA130596 | Hs.71331 | ESTs; Weakly similar to POTENT HEAT-STABLE PR | 5.0 |
| 110799 | N26101 | Hs. 7838 | Human nng zinc-finger protein (ZNF127-Xp) ge | 5.0 |
| 120619 | AA284372 | Hs. 111471 | ESTs | 5.0 |
| 122792 | AA460225 | Hs.99519 | ESTs | 5.0 |
| 129912 | AA047344 | Hs. 107213 | ESTs, Highly similar to NY-REN-6 antigen [H s | 5.0 |
| 102823 | U90914 | Hs. 5057 | carboxypeptidase D | 4.9 |
| 129890 | M13699 | Hs. 111461 | ceruloplasmin (ferroxidase) | 4.9 |
| 101084 | L05425 | | *Homo sapiens* autoantigen mRNA, complete cds | 4.9 |
| 134859 | D87716 | Hs. 90315 | KIAA0007 protein | 4.9 |
| 115955 | AA446121 | Hs.44198 | *Homo sapiens* BAC clone RG054D04 from 7q31 | 4.9 |
| 105516 | AA257971 | Hs. 21214 | ESTs | 4.9 |
| 114932 | AA242751 | Hs. 16218 | KIAA0903 protein | 4.9 |
| 106672 | AA461300 | Hs. 30643 | ESTs | 4.8 |
| 106126 | AA424006 | Hs. 22972 | ESTs, Moderately similar to H5AR [*M. musculus*] | 4.8 |
| 110695 | H93463 | Hs. 124777 | ESTs | 4.8 |
| 102025 | U03911 | Hs.78934 | matS (*E. coli*) homolog 2 (colon cancer, nonpo | 4.8 |
| 133282 | U52960 | Hs. 250855 | SRB7 (suppressor of RNA polymerase B; yeast) | 4.8 |
| 119708 | W67810 | Hs. 57904 | mago-nashi (Drosophila) homolog, proliferatio | 4.7 |
| 120695 | AA291468 | | ESTs | 4.7 |
| 128651 | AA446990 | Hs.103135 | ESTs | 4.7 |
| 103152 | X66533 | Hs. 77890 | guanylate cyclase 1, soluble, beta 3 | 4.7 |
| 108699 | AA121514 | Hs. 70832 | ESTs | 4.7 |
| 115094 | AA255921 | Hs. 88095 | ESTs | 4.7 |
| 121429 | AA406293 | Hs. 193498 | ESTs | 4.7 |
| 123203 | AA489671 | Hs. 89709 | glutamate-cysteine ligase (gamma-glutamylcyst | 4.7 |
| 126802 | AA947601 | Hs.97056 | ESTs | 4.7 |
| 130527 | C17384 | Hs.184227 | F-box protein 21 | 4.7 |
| 134470 | X54942 | Hs. 83758 | CDC28 protein kinase 2 | 4.7 |
| 100449 | D87470 | Hs. 75400 | KIAA0280 protein | 4.7 |
| 110970 | N51374 | Hs. 96870 | *Homo sapiens* mRNA full length insert cDNA clo | 4.7 |
| 115901 | AA436403 | Hs. 86909 | ESTs; Moderately similar to Frizzled-6 [H.sap | 4.7 |
| 109799 | F10770 | Hs.180378 | *Homo sapiens* clone 669 unknown mRNA, complete | 4.6 |
| 116195 | AA465148 | Hs.72402 | ESTs | 4.6 |
| 132122 | U65092 | Hs. 40403 | Cbp/p300-interacting transactivator, with Glu | 4.6 |
| 108990 | AA152296 | Hs. 72045 | ESTs | 4.6 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 109055 | AA160529 | Hs. 48524 | ESTs | 4.6 |
| 115937 | AA443269 | Hs. 30991 | KIAA0957 protein | 4.6 |
| 133520 | X74331 | Hs. 74519 | primase, polypeptide 2A (58 kD) | 4.6 |
| 131200 | AA609427 | Hs.210706 | ESTs, Moderately similar to !!!! ALU SUBFAMIL | 4.6 |
| 121369 | AA405657 | Hs. 128791 | Human DNA sequence from clone 967N21 on chrom | 4.5 |
| 132880 | AA444369 | Hs. 177537 | ESTs | 4.5 |
| 127386 | AI457411 | Hs. 106728 | ESTs | 4.5 |
| 120067 | W93592 | Hs.47343 | ESTs | 4.5 |
| 122986 | AA479063 | Hs. 102947 | ESTs | 4.5 |
| 135286 | AA401269 | Hs. 97849 | ESTs | 4.5 |
| 130155 | L33404 | Hs. 151254 | kallikrein 7 (chymotryptic, stratum corneum) | 4.5 |
| 106103 | AA421104 | Hs. 12094 | ESTs | 4.5 |
| 102654 | U68494 | Hs.24385 | Human hbc647 mRNA sequence | 4.4 |
| 107876 | AA025315 | Hs. 61184 | Novel human gene mapping to chomosome X | 4.4 |
| 109454 | AA232255 | Hs. 46912 | ESTs | 4.4 |
| 125960 | D63307 | Hs.145968 | ESTs | 4.4 |
| 126892 | AI160190 | Hs. 76127 | hect (homologous to the E6-AP (UBE3A) carboxy | 4.4 |
| 100269 | D38550 | Hs.1189 | E2F transcription factor 3 | 4.4 |
| 134161 | U97188 | Hs. 79440 | IGF-II mRNA-binding protein 3 | 4.3 |
| 100502 | HG1496-HT1496 | | Adrenal-Specific Protein Pg2 | 4.3 |
| 105542 | AA261858 | Hs. 8241 | ESTs, Weakly similar to heat shock protein hs | 4.3 |
| 109787 | F10610 | Hs. 34853 | inhibitor of DNA binding 4, dominant negative | 4.3 |
| 110759 | N21671 | Hs.19025 | ESTs | 4.3 |
| 129970 | AA478975 | Hs. 200434 | ESTs | 4.3 |
| 134666 | AA482319 | Hs. 8752 | putative type II membrane protein | 4.3 |
| 117693 | N40939 | Hs.44162 | ESTs, Weakly similar to cDNA EST yk342h125 c | 4.3 |
| 111008 | N53388 | Hs. 7222 | ESTs | 4.3 |
| 120977 | AA398155 | Hs. 97600 | ESTs | 4.2 |
| 105808 | AA393808 | Hs. 21490 | KIAA0438 gene product | 4.2 |
| 121381 | AA405747 | Hs.97865 | ESTs, Weakly similar to WASP-family protein [ | 4.2 |
| 100893 | HG4557-HT4962 | | Small Nuclear Ribonucleoprotein U1, 1snrp | 4.2 |
| 107176 | AA621762 | Hs. 7576 | ESTs | 4.2 |
| 118976 | N93629 | Hs. 93391 | ESTs | 4.2 |
| 130703 | N63295 | Hs. 18103 | ESTs | 4.2 |
| 106540 | AA454607 | Hs. 38114 | ESTs, Weakly similar to coded for by C.elega | 4.2 |
| 119367 | T78324 | Hs.90905 | ESTs | 4.2 |
| 133633 | D21262 | Hs. 75337 | nucleolar phosphoprotein p130 | 4.2 |
| 105520 | AA258068 | Hs. 33085 | WD repeat domain 3 | 4.2 |
| 114264 | Z40074 | Hs. 27595 | ESTs | 4.1 |
| 131046 | X02530 | Hs. 2248 | IP10; small inducible cytokine subfamily B ( | 4.1 |
| 105220 | AA210695 | Hs. 17212 | ESTs | 4.1 |
| 103111 | X63187 | Hs. 2719 | epididymis-specific, whey-acidic protein type | 4.1 |
| 125640 | R37700 | Hs. 208261 | ESTs | 4.1 |
| 110561 | H59617 | Hs. 5199 | ESTs, Weakly similar to UBIQUITIN-CONJUGATING | 4.1 |
| 118092 | N54915 | Hs.82719 | mRNA, cDNA DKFZp586F1822 (from c | 4.1 |
| 134891 | F03517 | Hs. 90787 | ESTs | 4.1 |
| 112364 | R59312 | Hs. 197642 | ESTs, Weakly similar to DNA-DIRECTED RNA POLY | 4.1 |
| 120699 | AA291716 | Hs. 97258 | ESTs | 4.1 |
| 106272 | AA432074 | Hs. 32538 | ESTs | 4.1 |
| 112041 | R43300 | Hs.22929 | ESTs | 4.1 |
| 131689 | AA599653 | Hs.30696 | transcription factor-like 5 (basic helix-loop | 4.1 |
| 116134 | AA460246 | Hs. 50441 | ESTs, Highly similar to CGI-04 protein [H.sap | 4.1 |
| 107638 | AA009528 | Hs. 42743 | ESTs, Weakly similar to predicted using Genef | 4.0 |
| 131941 | D62657 | Hs. 35086 | ubiquitin-specific protease 1 | 4.0 |
| 106154 | AA425304 | Hs. 6994 | ESTs | 4.0 |
| 105546 | AA262032 | Hs.26089 | ESTs, Weakly similar to 62D9 a [D.melanogaste | 4.0 |
| 106319 | AA436606 | Hs.7392 | ESTs, Weakly similar to Gu protein [*H. sapiens* | 4.0 |
| 121816 | AA424814 | Hs. 187509 | ESTs | 4.0 |
| 122851 | AA463627 | Hs.99598 | ESTs | 4.0 |
| 123337 | AA504153 | Hs. 132797 | ESTs, Weakly similar to ORF YGL050w [*S.cerevi* | 4.0 |
| 128643 | N40212 | Hs. 102958 | ESTs | 4.0 |
| 129011 | S72869 | Hs. 107932 | DNA segment, single copy, probe pH4 (transfor | 4.0 |
| 130895 | AA609828 | Hs.21015 | ESTs, Highly similar to tetracycline transpor | 4.0 |
| 132323 | AA436102 | Hs. 256559 | ESTs | 4.0 |
| 134255 | J05032 | Hs. 80758 | aspartyl-tRNA synthetase | 4.0 |
| 102827 | U91327 | Hs. 6456 | chaperonin containing TCP1; subunit 2 (beta) | 4.0 |
| 102123 | U14518 | Hs. 1594 | centromere protein A (17 kD) | 4.0 |
| 102813 | U90651 | Hs. 151461 | embryonic ectoderm development protein | 3.9 |
| 113970 | W86748 | Hs.8109 | ESTs | 3.9 |
| 107145 | AA621108 | Hs.173001 | ESTs | 3.9 |
| 114212 | Z39338 | Hs. 21201 | DKFZP566B0846 protein | 3.9 |
| 106614 | AA458934 | Hs. 179912 | ESTs | 3.9 |
| 132742 | AA490862 | Hs. 55901 | ESTs; Weakly similar to C43H8 1 [*C. elegans*] | 3.9 |
| 120948 | AA397822 | Hs.104650 | ESTs, Highly similar to similar to mago nashi | 3.9 |
| 129337 | R63542 | Hs. 110488 | KIAA0990 protein | 3.9 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 103835 | AA172215 | Hs. 93748 | ESTs, Moderately similar to TRANSCRIPTION FAC | 3.9 |
| 133330 | U42360 | Hs. 71119 | Putative prostate cancer tumor suppressor | 3.9 |
| 133928 | N34096 | Hs.7766 | ubiquitin-conjugating enzyme E2E 1 (homologou | 3.9 |
| 133640 | D83004 | Hs.75355 | ubiquitin-conjugating enzyme E2N (homologous | 3.9 |
| 133350 | AA135468 | Hs. 71573 | ESTs | 3.9 |
| 115623 | AA401475 | Hs. 39733 | postsynaptic protein CRIPT | 3.9 |
| 101973 | S82597 | Hs. 80120 | UDP-N-acetyl-alpha-D-galactosamine polypeptid | 3.9 |
| 102669 | U71207 | Hs. 29279 | eyes absent (Drosophila) homolog 2 | 3.9 |
| 134248 | AA292677 | Hs.80624 | ESTs | 3.9 |
| 102380 | U40434 | Hs.155981 | mesothelin | 3.9 |
| 116157 | AA461063 | Hs. 44298 | ESTs; Highly similar to HSPC011 [*H. sapiens*] | 3.8 |
| 106691 | AA463453 | Hs. 23259 | ESTs, Weakly similar to ACTIN, CYTOPLASMIC 2 | 3.8 |
| 115844 | AA430124 | Hs. 234607 | ESTs | 3.8 |
| 107159 | AA621340 | Hs. 10600 | ESTs, Weakly similar to ORF YKR081c [*S.cerevi* | 3.8 |
| 106498 | AA452141 | Hs. 7171 | ESTs | 3.8 |
| 134405 | J04177 | Hs. 82772 | collagen, type XI, alpha 1 | 3.8 |
| 106260 | AA431448 | Hs. 5250 | ESTs; Weakly similar to BACR37P7 g [D.melanog | 3.8 |
| 109864 | H02554 | Hs.30323 | ESTs | 3.8 |
| 124648 | N91948 | Hs. 125034 | ESTs | 3.8 |
| 134719 | L07515 | Hs. 89232 | chromobox homolog 5 (Drosophila HP1 alpha) | 3.8 |
| 113702 | T97307 | Hs. 161720 | ESTs; Moderately similar to !!!! ALU SUBFAMIL | 3.8 |
| 128639 | N91246 | Hs.102897 | ESTs | 3.8 |
| 111299 | N73808 | Hs. 24936 | ESTs | 3.7 |
| 129351 | AA167268 | Hs. 62349 | Human ras inhibitor mRNA, 3'end | 3.7 |
| 119741 | W70205 | Hs. 43670 | kinesin family member 3A | 3.7 |
| 105012 | AA116036 | Hs.9329 | chromosome 20 open reading frame 1 | 3.7 |
| 128734 | AA343629 | Hs. 104570 | kallikrein 8 (neuropsin/ovasin) | 3.7 |
| 130567 | L07493 | Hs. 1608 | replication protein A3 (14 kD) | 3.7 |
| 114253 | Z39909 | Hs. 14831 | ESTs | 3.7 |
| 103169 | X68560 | Hs. 44450 | Sp3 transcription factor | 3.7 |
| 111269 | N70711 | Hs. 18885 | ESTs; Highly similar to CGI-116 protein [H.sa | 3.7 |
| 112876 | T03488 | Hs. 4842 | ESTs | 3.7 |
| 118261 | N62780 | Hs.94122 | ESTs | 3.7 |
| 130385 | AA126474 | Hs. 155223 | stanniocalcin 2 | 3.7 |
| 129300 | C20976 | Hs. 110165 | ESTs, Highly similar to ribosomal protein L26 | 3.7 |
| 134388 | M15841 | Hs. 82575 | small nuclear ribonucleoprotein polypeptide B | 3.7 |
| 106968 | AA504631 | Hs. 26813 | ESTs; Weakly similar to hypothetical 43.2 kDa | 3.7 |
| 100906 | HG4716-HT5158 | | Guanosine 5'-Monaphosphate Synthase | 3.7 |
| 100418 | D86978 | Hs. 84790 | KIAA0225 protein | 3.7 |
| 101484 | M24594 | Hs. 20315 | Interferon-induced protein 56 | 3.7 |
| 102547 | U57911 | Hs.46638 | chromosome 11 open reading frame 8 | 3.7 |
| 103587 | Z29083 | Hs. 82128 | 5T4 oncofetal trophoblast glycoprotein | 3.7 |
| 130600 | AA478601 | Hs. 258737 | ESTs | 3.7 |
| 128733 | AA328993 | Hs. 104558 | ESTs | 3.7 |
| 134375 | AA412720 | Hs.82389 | ESTs; Highly similar to CGI-118 protein [H.sa | 3.7 |
| 134098 | X06323 | Hs. 79086 | ribosomal protein; mitochondrial, L3 | 3.6 |
| 101188 | L20320 | Hs. 184298 | cyclin-dependent kinase 7 (homolog of Xenopus | 3.6 |
| 132149 | T10822 | Hs. 4095 | ESTs | 3.6 |
| 116200 | AA465358 | Hs. 118793 | ESTs; Highly similar to p621 [*H. sapiens*] | 3.6 |
| 121920 | AA428300 | Hs.161841 | ESTs | 3.6 |
| 128609 | AA234365 | Hs. 102456 | survival of motor neuron protein interacting | 3.6 |
| 101078 | L04510 | Hs. 792 | ADP-ribosylation factor domain protein 1, 64 k | 3.6 |
| 108693 | AA121289 | Hs. 49597 | ESTs; Highly similar to retinoic acid-induced | 3.6 |
| 109139 | AA176121 | Hs. 59757 | zinc finger protein 281 | 3.6 |
| 111870 | R37778 | Hs. 18685 | ESTs, Weakly similar to hypothetical protein | 3.6 |
| 113848 | W60080 | Hs. 27099 | DKFZP564J0863 protein | 3.6 |
| 127947 | AI432475 | Hs. 146327 | ESTs | 3.6 |
| 128056 | AI379480 | Hs.125449 | ESTs, Weakly similar to MaxiK channel beta 2 | 3.6 |
| 129914 | U22377 | Hs. 13321 | rearranged L-myc fusion sequence | 3.6 |
| 132148 | AA283988 | Hs. 4094 | ESTs | 3.6 |
| 134644 | S83308 | Hs. 87224 | SRY (sex-determining region Y)-box 5 | 3.6 |
| 115047 | AA252627 | Hs. 22554 | homeo box B5 | 3.6 |
| 102398 | U42359 | | Human N33 protein form 1 (N33) gene, exon 1 a | 3.6 |
| 127479 | AA513722 | Hs. 179729 | collagen; type X, alpha 1 (Schmid metaphyseal | 3.6 |
| 105545 | AA262030 | Hs. 5152 | ESTs, Weakly similar to katanin p80 subunit [ | 3.6 |
| 101483 | M24486 | Hs.76768 | procollagen-proline, 2-oxoglutarate 4-dioxyge | 3.6 |
| 105709 | AA291268 | Hs. 26761 | DKFZP586L0724 protein | 3.6 |
| 122636 | AA454103 | Hs. 110031 | ESTs | 3.6 |
| 124792 | R44357 | Hs. 132784 | ESTs; Weakly similar to cDNA EST EMBL T01421 | 3.6 |
| 103621 | Z47727 | Hs.150675 | polymerase (RNA) II (DNA directed) polypeptid | 3.5 |
| 105427 | AA251330 | Hs. 28248 | ESTs | 3.5 |
| 121553 | AA412488 | Hs. 48820 | ESTs | 3.5 |
| 115167 | AA258421 | Hs. 43728 | hypothetical protein | 3.5 |
| 134570 | U66615 | Hs.172280 | SWI/SNF related; matrix associated, actin dep | 3.5 |
| 110787 | N24716 | Hs. 12244 | ESTs, Weakly similar to C44B9 1 [*C. elegans*] | 3.5 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 131621 | U77665 | Hs. 139120 | ribonuclease P (30 kD) | 3.5 |
| 132813 | N72116 | Hs. 57435 | solute carrier family 11 (proton-coupled diva | 3.5 |
| 116370 | AA521256 | Hs.236204 | ESTs; Moderately similar to NUCLEAR PORE COMP | 3.5 |
| 131965 | W90146 | Hs. 35962 | ESTs | 3.5 |
| 115221 | AA262942 | Hs. 79741 | ESTs | 3.5 |
| 116093 | AA456020 | Hs. 50848 | ESTs, Weakly similar to KIAA0862 protein [H s | 3.5 |
| 123507 | AA600176 | Hs. 112345 | ESTs | 3.5 |
| 129801 | F11087 | Hs. 239666 | ESTs | 3.5 |
| 115084 | AA255566 | Hs.42484 | mRNA, cDNA DKFZp564C053 (from cl | 3.5 |
| 123442 | AA598803 | Hs. 111496 | ESTs | 3.5 |
| 115061 | AA253217 | Hs. 41271 | ESTs | 3.5 |
| 100146 | D13645 | Hs. 2471 | KIAA0020 gene product | 3.5 |
| 115140 | AA258030 | Hs.55356 | ESTs, Weakly similar to supported by GENSCAN | 3.5 |
| 115360 | AA281950 | Hs. 5057 | carboxypeptidase D | 3.5 |
| 130261 | D83767 | Hs. 153678 | reproduction 8 | 3.4 |
| 100824 | HG4058-HT4328 | | Oncogene Aml1-Evi-1, Fusion Activated | 3.4 |
| 102287 | U31814 | Hs. 3352 | histone deacetylase 2 | 3.4 |
| 102788 | U86602 | Hs. 74407 | nucleolar protein p40 | 3.4 |
| 118836 | N79820 | Hs. 50854 | ESTs | 3.4 |
| 102423 | U44754 | Hs.179312 | small nuclear RNA activating complex, polypep | 3.4 |
| 106300 | AA435840 | Hs. 19114 | high-mobility group (nonhistone chromosomal) | 3.4 |
| 106156 | AA425354 | Hs. 4210 | ESTs | 3.4 |
| 106483 | AA451676 | Hs. 30299 | IGF-II mRNA-binding protein 2 | 3.4 |
| 107868 | AA025234 | Hs.61260 | ESTs | 3.4 |
| 108187 | AA056538 | Hs. 27842 | ESTs, Weakly similar to similar to 1-acyl-gly | 3.4 |
| 116123 | AA459282 | Hs. 43756 | ESTs | 3.4 |
| 119501 | W37721 | Hs. 151363 | ESTs | 3.4 |
| 129121 | AA127459 | Hs.108788 | ESTs, Weakly similar to zeste [*D. melanogaster* | 3.4 |
| 131638 | D87120 | Hs.29882 | predicted osteoblast protein | 3.4 |
| 132962 | N34893 | Hs. 6153 | ESTs, Highly similar to CGI-48 protein [H.sap | 3.4 |
| 133767 | D63875 | Hs. 173288 | KIAA0155 gene product | 3.4 |
| 111823 | R35253 | Hs. 24944 | ESTs | 3.4 |
| 134372 | D63877 | Hs. 82324 | KIAA0157 protein | 3.4 |
| 130938 | AA013250 | Hs.21398 | ESTs, Moderately similar to PUTATIVE GLUCOSAM | 3.4 |
| 115169 | AA258427 | Hs. 58427 | ESTs | 3.4 |
| 123978 | C20653 | Hs. 170278 | ESTs | 3.4 |
| 108807 | AA129968 | Hs.49376 | ESTs, Weakly similar to PROTEIN PHOSPHATASE P | 3.4 |
| 132581 | R42266 | Hs. 52256 | ESTs, Weakly similar to beta-TrCP protein E3R | 3.4 |
| 134654 | W23625 | Hs. 8739 | ESTs; Weakly similar to ORF YGR200c [S.cerevi | 3.4 |
| 105730 | AA292701 | Hs. 5364 | DKFZP564I052 protein | 3.4 |
| 111295 | N73275 | Hs.21275 | ESTs, Weakly similar to ubiquitin-conjugating | 3.3 |
| 102009 | U02680 | Hs. 82643 | protein tyrosine kinase 9 | 3.3 |
| 114161 | Z38904 | Hs. 22385 | ESTs, Weakly similar to KIAA0970 protein [H s | 3.3 |
| 130604 | X03635 | Hs. 1657 | estrogen receptor 1 | 3.3 |
| 100103 | AF007875 | Hs. 5085 | dolichyl-phosphate mannosyltransferase polype | 3.3 |
| 121748 | AA421171 | Hs. 234545 | ESTs | 3.3 |
| 106698 | AA463745 | Hs. 29403 | ESTs, Weakly similar to PROBABLE ATP-DEPENDEN | 3.3 |
| 134353 | S77154 | Hs.82120 | nuclear receptor subfamily 4, group A; member | 3.3 |
| 134154 | AA211320 | Hs.79404 | neuron-specific protein | 3.3 |
| 133142 | F03321 | Hs. 65874 | ESTs | 3.3 |
| 124461 | N50641 | Hs. 80285 | *Homo sapiens* mRNA, cDNA DKFZp586C1723 (from c | 3.3 |
| 104903 | AA055534 | Hs. 124134 | ESTs | 3.3 |
| 106772 | AA478106 | Hs.12692 | ESTs, Weakly similar to protein phosphatase-1 | 3.3 |
| 109704 | F09687 | Hs. 12876 | ESTs | 3.3 |
| 111131 | N64267 | Hs. 10177 | ESTs | 3.3 |
| 115019 | AA251906 | Hs.48473 | ESTs | 3.3 |
| 116019 | AA450312 | Hs. 237480 | *Homo sapiens* mRNA, cDNA DKFZp434E102 (from cl | 3.3 |
| 118528 | N67889 | Hs. 49397 | ESTs | 3.3 |
| 124027 | F03625 | Hs. 107537 | ESTs | 3.3 |
| 131699 | R68657 | Hs.90421 | ESTs; Moderately similar to !!!! ALU SUBFAMIL | 3.3 |
| 111044 | N55443 | Hs.23625 | ESTs | 3.3 |
| 103768 | AA089997 | Hs. 180320 | ESTs, Weakly similar to GOLGI 4-TRANSMEMBRANE | 3.3 |
| 131882 | N49091 | Hs. 3385 | ESTs, Highly similar to CGI-134 protein [H.sa | 3.3 |
| 123673 | AA609471 | Hs. 112712 | ESTs | 3.3 |
| 132936 | AB002305 | Hs. 6111 | KIAA0307 gene product | 3.3 |
| 103023 | X53793 | Hs.117950 | multifunctional polypeptide similar to SAICAR | 3.3 |
| 120572 | AA280794 | Hs. 258787 | ESTs | 3.3 |
| 132384 | AA479933 | Hs. 46967 | Human DNA sequence from clone 167A19 on chrom | 3.3 |
| 105658 | AA282914 | Hs. 10176 | ESTs | 3.2 |
| 105086 | AA147719 | Hs.159441 | ESTs | 3.2 |
| 118695 | N71781 | Hs. 50081 | *Homo sapiens* mRNA full length insert cDNA clo | 3.2 |
| 112092 | R44538 | Hs. 140889 | ESTs | 3.2 |
| 125154 | W38419 | Hs.24936 | ESTs | 3.2 |
| 108040 | AA041551 | Hs. 48644 | ESTs | 3.2 |
| 133453 | M68941 | Hs. 73826 | protein tyrosine phosphatase; non-receptor ty | 3.2 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 124006 | D60302 | Hs. 108977 | ESTs | 3.2 |
| 116083 | AA455653 | Hs. 44581 | ESTs; Weakly similar to HEAT SHOCK 70 KD PROT | 3.2 |
| 106753 | AA476944 | Hs. 7331 | ESTs | 3.2 |
| 102621 | U66075 | Hs. 50924 | GATA-binding protein 6 | 3.2 |
| 103330 | X85373 | Hs.77496 | small nuclear ribonucleoprotein polypeptide G | 3.2 |
| 128926 | AA481403 | Hs.107213 | ESTs, Highly similar to NY-REN-6 antigen [H.s | 3.2 |
| 101167 | L15309 | Hs. 193677 | zinc finger protein 141 (clone pHZ-44) | 3.2 |
| 104055 | AA393755 | Hs. 117211 | ESTs, Highly similar to CGI-62 protein [H.sap | 3.2 |
| 112917 | T10196 | Hs. 4263 | ESTs, Weakly similar to/prediction | 3.2 |
| 120358 | AA213459 | Hs. 100932 | transcription factor 17 | 3.2 |
| 121857 | AA426017 | Hs.62694 | ESTs, Highly similar to DNA-REPAIR PROTEIN CO | 3.2 |
| 122124 | AA434257 | Hs. 186679 | ESTs; Moderately similar to !!!! ALU SUBFAMIL | 3.2 |
| 132231 | H99131 | Hs. 42635 | ESTs | 3.2 |
| 134272 | X76040 | Hs. 223014 | protease; serine, 15 | 3.2 |
| 115860 | AA431719 | Hs.61809 | ESTs | 3.2 |
| 115278 | AA279757 | Hs.67466 | ESTs, Weakly similar to BACN32G11 d [D melano | 3.2 |
| 134125 | R38102 | Hs. 50421 | KIAA0203 gene product | 3.2 |
| 129160 | AA131252 | Hs. 109007 | ESTs | 3.2 |
| 121710 | AA419011 | Hs. 96744 | DKFZP586D0823 protein | 3.2 |
| 102242 | U27185 | Hs. 32943 | retinoic acid receptor responder (tazarotene | 3.2 |
| 104956 | AA074880 | Hs. 120915 | ESTs, Weakly similar to hypothetical protein | 3.2 |
| 113047 | T25867 | Hs.7549 | ESTs | 3.2 |
| 115017 | AA251880 | Hs. 179982 | tumor protein p53-binding protein | 3.2 |
| 133780 | M14219 | Hs. 76152 | decorin | 3.1 |
| 129453 | AA421213 | Hs. 111632 | Lsm3 protein | 3.1 |
| 130353 | X86018 | Hs. 172210 | MUF1 protein | 3.1 |
| 106036 | AA412505 | Hs.10653 | ESTs | 3.1 |
| 102234 | U26312 | Hs. 8123 | chromobox homolog 3 (Drosophila HP1 gamma) | 3.1 |
| 106133 | AA424346 | Hs. 107573 | sialyltransferase | 3.1 |
| 116803 | H47357 | | ESTs, Moderately similar to weak similarity t | 3.1 |
| 106721 | AA465194 | Hs. 6670 | ESTs | 3.1 |
| 107115 | AA610108 | Hs. 27693 | ESTs; Highly similar to CGI-124 protein [H.sa | 3.1 |
| 133228 | N90029 | Hs. 6831 | Homo sapiens clone 1400 unknown protein mRNA; | 3.1 |
| 104733 | AA019498 | Hs.23071 | ESTs | 3.1 |
| 103879 | AA228148 | Hs. 50252 | ESTs, Weakly similar to putative [C. elegans] | 3.1 |
| 103038 | X54941 | Hs. 77550 | CDC28 protein kinase 1 | 3.1 |
| 135154 | AA126433 | Hs.173242 | sorting nexin 4 | 3.1 |
| 114860 | AA235112 | Hs. 106227 | ESTs, Moderately similar to similar to murine | 3.1 |
| 102437 | U46569 | Hs. 221986 | aquaporin 5 | 3.1 |
| 100352 | D64159 | | Homo sapiens mRNA for 3–7 gene product parti | 3.1 |
| 103631 | Z48570 | | H. sapiens Sp17 gene | 3.1 |
| 104238 | AB002364 | Hs.27916 | a disintegrin-like and metalloprotease (repro | 3.1 |
| 108613 | AA100967 | Hs. 69165 | ESTs | 3.1 |
| 115915 | AA436884 | Hs. 48926 | ESTs | 3.1 |
| 120640 | AA286945 | Hs. 163933 | ESTs | 3.1 |
| 124068 | H03099 | Hs. 101619 | ESTs | 3.1 |
| 130375 | U91931 | Hs.155172 | adaptor-related protein complex 3, beta 1 sub | 3.1 |
| 131632 | AA443671 | Hs.29826 | ESTs | 3.1 |
| 131523 | H88801 | Hs. 201676 | M phase phosphoprotein 10 (U3 small nucleolar | 3.1 |
| 115827 | AA427890 | Hs. 44426 | ESTs; Weakly similar to PHOSPHOLIPID HYDROPER | 3.1 |
| 108828 | AA131584 | Hs.71435 | DKFZP564O0463 protein | 3.1 |
| 112198 | R49483 | Hs. 22159 | ESTs, Weakly similar to ZINC FINGER PROTEIN H | 3.1 |
| 123960 | AA621785 | Hs. 170008 | methylmalonate-semialdehyde dehydrogenase | 3.1 |
| 131538 | Z29331 | Hs.28505 | ubiquitin-conjugating enzyme E2H (homologous | 3.1 |
| 105616 | AA280670 | Hs. 24968 | ESTs | 3.1 |
| 101228 | L27706 | Hs. 82916 | chaperonin containing TCP1; subunit 6A (zeta | 3.1 |
| 100280 | D42085 | Hs. 155314 | KIAA0095 gene product | 3.1 |
| 132744 | X54326 | Hs. 55921 | glutamyl-prolyl-tRNA synthetase | 3.1 |
| 103105 | X61970 | Hs.76913 | proteasome (prosome; macropain) subunit, alph | 3.1 |
| 106984 | AA521201 | Hs.7129 | ESTs | 3.1 |
| 105127 | AA158132 | Hs. 11817 | ESTs; Weakly similar to contains similarity t | 3.1 |
| 102302 | U33052 | Hs. 69171 | protein kinase C-like 2 | 3.1 |
| 117708 | N45114 | Hs. 46476 | ESTs | 3.1 |
| 111314 | N74574 | Hs. 33922 | H. sapiens novel gene from PAC 117P20; chromos | 3.0 |
| 132902 | AA490969 | Hs. 168147 | ESTs | 3.0 |
| 130356 | X84373 | Hs.155017 | nuclear receptor interacting protein 1 | 3.0 |
| 128420 | AI088155 | Hs. 14146 | ESTs, Weakly similar to unknown [H. sapiens] | 3.0 |
| 108746 | AA126974 | Hs. 43388 | ESTs | 3.0 |
| 127236 | AI341818 | Hs. 98658 | budding uninhibited by beazimidazoles 1 (yeas | 3.0 |
| 114208 | Z39301 | Hs.7859 | ESTs | 3.0 |
| 107071 | AA609053 | Hs. 35198 | ESTs | 3.0 |
| 104957 | AA074919 | Hs. 10026 | ESTs; Weakly similar to ORF YJL063c [S.cerevi | 3.0 |
| 124073 | H05394 | Hs.127376 | KIAA0266 gene product | 3.0 |
| 130869 | AA128100 | Hs. 2057 | uridine monophosphate synthetase (orotate pho | 3.0 |
| 101232 | L28997 | Hs. 242894 | ADP-ribosylation factor-like 1 | 3.0 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 104276 | C02193 | Hs. 85222 | ESTs, Weakly similar to R27090_2 [*H. sapiens*] | 3.0 |
| 126160 | N90960 | Hs. 247277 | ESTs, Weakly similar to transformation-relate | 3.0 |
| 128584 | M11433 | Hs.101850 | retinol-binding protein 1, cellular | 3.0 |
| 100405 | D86425 | Hs. 82733 | nidogen 2 | 3.0 |
| 101335 | L49054 | | *Homo sapiens* t(3;5)(q25 1, p34) fusion gene NP | 3.0 |
| 108761 | AA127514 | Hs. 61603 | ESTs | 3.0 |
| 111346 | N89829 | Hs.13259 | ESTs | 3.0 |
| 114988 | AA251089 | Hs. 94576 | ESTs; Weakly similar to phosducin; retinal [H | 3.0 |
| 116008 | AA449338 | Hs.48589 | ESTs; Weakly similar to finger protein HZF6; | 3.0 |
| 116545 | D20313 | Hs. 74899 | ESTs | 3.0 |
| 117873 | N49967 | Hs. 46624 | ESTs | 3.0 |
| 121463 | AA411745 | Hs.239681 | ESTs, Weakly similar to KIAA0554 protein [H.s | 3.0 |
| 128625 | AA242816 | Hs. 102652 | ESTs, Weakly similar to KIAA0437 [*H. sapiens*] | 3.0 |
| 131185 | M25753 | Hs. 23960 | cyclin B1 | 3.0 |
| 134380 | D38073 | Hs. 179565 | minichromosome maintenance deficient (S cere | 3.0 |
| 105740 | AA293206 | Hs. 10852 | ESTs | 3.0 |
| 130919 | AA291710 | Hs. 21276 | collagen; type IV; alpha 3 (Goodpasture antig | 3.0 |
| 134423 | W96151 | Hs.83006 | ESTs, Highly similar to CGI-139 protein [H.sa | 3.0 |
| 104896 | AA054228 | Hs.23165 | ESTs | 3.0 |
| 134407 | X72964 | Hs. 82794 | caltractin (20 kD calcium-binding protein) | 3.0 |
| 106378 | AA445994 | Hs. 21331 | ESTs | 3.0 |
| 112283 | R53545 | Hs. 20952 | *Homo sapiens* clone 24411 mRNA sequence | 3.0 |
| 109018 | AA156960 | Hs. 114992 | ESTs | 3.0 |
| 114239 | Z39742 | Hs. 222478 | ESTs | 3.0 |
| 114969 | AA250775 | Hs.87747 | ESTs | 3.0 |
| 116408 | AA608752 | Hs. 71969 | *Homo sapiens* mRNA, cDNA DKFZp564P0823 (from c | 3.0 |
| 115286 | AA279803 | Hs. 82204 | ESTs | 2.9 |
| 105809 | AA393827 | Hs. 20104 | ESTs | 2.9 |
| 113811 | W44928 | Hs. 4878 | ESTs | 2.9 |
| 107248 | D59894 | Hs.34782 | ESTs | 2.9 |
| 134489 | U09284 | Hs. 112378 | LIM and senescent cell antigen-like domains 1 | 2.9 |
| 134064 | D87685 | Hs. 78893 | KIAA0244 protein | 2.9 |
| 127370 | AI024352 | Hs.70337 | immunoglobulin superfamily, member 4 | 2.9 |
| 113277 | T65797 | Hs. 11774 | protein (peptidyl-prolyl cis/trans isomerase) | 2.9 |
| 132783 | N74897 | Hs. 5683 | DEAD/H (Asp-Glu-Ala-Asp/His) box polypeptide | 2.9 |
| 109010 | AA156460 | Hs. 44229 | dual specificity phosphatase 12 | 2.9 |
| 130095 | F01831 | Hs.14838 | ESTs | 2.9 |
| 106618 | AA459249 | Hs. 8715 | ESTs, Weakly similar to Similarity with snail | 2.9 |
| 103427 | X97303 | | *H. sapiens* mRNA for Ptg-12 protein | 2.9 |
| 133980 | D00760 | Hs. 181309 | proteasome (prosome, macropain) subunit; alph | 2.9 |
| 111353 | N90430 | Hs.6616 | ESTs | 2.9 |
| 105344 | AA235303 | Hs. 8645 | ESTs | 2.9 |
| 134498 | M63180 | Hs. 84131 | threonyl-tRNA synthetase | 2.9 |
| 117910 | N50828 | Hs. 12940 | zinc-fingers and homeoboxes 1 | 2.9 |
| 118903 | N90774 | Hs. 132207 | ESTs; Moderately similar to !!!! ALU SUBFAMIL | 2.9 |
| 121713 | AA419198 | Hs. 105577 | ESTs | 2.9 |
| 129080 | H19307 | Hs.108507 | ESTs | 2.9 |
| 129404 | AA172056 | Hs.111128 | ESTs | 2.9 |
| 129457 | X55330 | Hs. 207776 | aspartylglucosaminidase | 2.9 |
| 130352 | D87450 | Hs. 154978 | KIAA0261 protein | 2.9 |
| 133415 | X69699 | Hs.73149 | paired box gene 8 | 2.9 |
| 120649 | AA287115 | Hs.99697 | ESTs | 2.9 |
| 131257 | AA256042 | Hs. 24908 | ESTs | 2.9 |
| 134480 | AA024664 | Hs. 83916 | NADH dehydrogenase (ubiquinone) 1 alpha subco | 2.9 |
| 116734 | F13789 | Hs. 93796 | DKFZP586D2223 protein | 2.9 |
| 105028 | AA126719 | Hs.25282 | ESTs | 2.9 |
| 114986 | AA251010 | Hs. 87807 | ESTs | 2.9 |
| 105651 | AA282481 | Hs. 18439 | ESTs | 2.9 |
| 101714 | M68874 | | Human phosphatidylcholine 2-acylhydrolase (cP | 2.9 |
| 123398 | AA521265 | Hs. 105514 | ESTs | 2.9 |
| 106007 | AA411462 | Hs. 11042 | ESTs; Weakly similar to veli 1 [*H. sapiens*] | 2.9 |
| 109450 | AA232183 | Hs. 173042 | ESTs, Weakly similar to !!!! ALU SUBFAMILY J | 2.9 |
| 104685 | AA010530 | Hs.9599 | Human BAC clone GS025M02 from 7q21–q22 | 2.9 |
| 108677 | AA115629 | Hs. 118531 | ESTs | 2.9 |
| 116028 | AA452112 | Hs.42644 | thioredoxin-like | 2.9 |
| 105404 | AA243303 | Hs. 21187 | ESTs | 2.9 |
| 132365 | AA598694 | Hs. 46541 | *Homo sapiens* PAC clone DJ0894A10 from 7q32–q3 | 2.9 |
| 119638 | W52480 | Hs. 56148 | ESTs, Moderately similar to NY-REN-58 antigen | 2.9 |
| 124637 | N80716 | Hs.75798 | Human DNA sequence from clone 1183I21 on chro | 2.9 |
| 130588 | AA287735 | Hs. 16411 | Human DNA sequence from clone 1189B24 on chro | 2.9 |
| 105640 | AA281623 | Hs. 7525 | ESTs, Weakly similar to KIAA0742 protein [H.s | 2.9 |
| 131818 | Z39297 | Hs. 3281 | neuronal pentraxin II | 2.9 |
| 119298 | T23820 | Hs.155478 | cyclin T2 | 2.9 |
| 128742 | D00763 | Hs. 251531 | proteasome (prosome; macropain) subunit, alph | 2.9 |
| 115089 | AA255876 | Hs. 86919 | ESTs, Weakly similar to !!!! ALU SUBFAMILY J | 2.9 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 100468 | D89289 | Hs. 118722 | fucosyltransferase 8 (alpha (1:6) fucosyltran | 2.8 |
| 132920 | L06133 | Hs. 606 | ATPase; Cu++ transporting, alpha polypeptide | 2.8 |
| 113490 | T88700 | Hs. 173374 | ESTs | 2.8 |
| 133451 | Y00764 | Hs.73818 | ubiquinol-cytochrome c reductase hinge protei | 2.8 |
| 128770 | H98645 | Hs. 143460 | protein kinase C; nu | 2.8 |
| 129122 | N62515 | Hs. 108790 | ESTs | 2.8 |
| 104827 | AA035630 | Hs. 8551 | PRP4/STK/WD splicing factor | 2.8 |
| 111348 | N90041 | Hs. 9585 | ESTs | 2.8 |
| 130987 | R45698 | Hs.21893 | ESTs, Weakly similar to cAMP inducible 2 prot | 2.8 |
| 102139 | U15932 | Hs. 2128 | dual specificity phosphatase 5 | 2.8 |
| 114902 | AA236359 | Hs. 39504 | ESTs | 2.8 |
| 106094 | AA419461 | Hs. 18127 | ESTs | 2.8 |
| 126438 | N93125 | Hs. 137300 | ESTs | 2.8 |
| 107129 | AA620553 | Hs.4756 | flap structure-specific endonuclease 1 | 2.8 |
| 104491 | N71513 | Hs. 39328 | ESTs | 2.8 |
| 105043 | AA132239 | Hs. 11810 | ESTs, Weakly similar to CD4 2 [*C. elegans*] | 2.8 |
| 106855 | AA486182 | Hs. 17975 | ESTs | 2.8 |
| 109695 | F09530 | Hs. 180591 | ESTs; Weakly similar to R06F6 5b [*C. elegans*] | 2.8 |
| 120455 | AA251083 | Hs. 104347 | ESTs | 2.8 |
| 130861 | N23393 | Hs.20509 | ESTs | 2.8 |
| 131649 | AA481254 | Hs. 30120 | ESTs | 2.8 |
| 128517 | AA280617 | Hs. 100861 | ESTs, Weakly similar to p60 katanin [*H.sapien* | 2.8 |
| 100486 | HG1112-HT1112 | | Ras-Like Protein Tc4 | 2.8 |
| 116729 | F13700 | Hs.115823 | ribonuclease P, 40 kD subunit | 2.8 |
| 101851 | M94250 | Hs. 82045 | midkine (neurite growth-promoting factor 2) | 2.8 |
| 115465 | AA286941 | Hs. 43691 | ESTs | 2.8 |
| 100137 | D13627 | Hs. 15071 | chaperonin containing TCP1, subunit 8 (theta) | 2.8 |
| 125837 | H05323 | Hs.146401 | endothelial monocyte-activating polypeptide | 2.8 |
| 131562 | U90551 | Hs. 28777 | H2A histone family; member L | 2.8 |
| 129445 | AA306121 | Hs. 111515 | ESTs, Weakly similar to predicted using Genef | 2.8 |
| 129239 | D31544 | Hs.109701 | ESTs; Moderately similar to weak similarity t | 2.8 |
| 106507 | AA452584 | Hs.91585 | protein phosphatase 1, regulatory (inhibitor) | 2.8 |
| 101664 | M60752 | Hs. 121017 | H2A histone family; member A | 2.8 |
| 129426 | AA412087 | Hs. 168272 | EST, Highly similar to protein inhibitor of a | 2.8 |
| 103437 | X98260 | Hs. 82254 | M-phase phosphoprotein 11 | 2.8 |
| 129821 | F11019 | Hs. 12696 | cortactin SH3 domain-binding protein | 2.8 |
| 130160 | Z39228 | Hs. 151344 | UDP-Gal.betaGlcNAc beta 1;3-galactosyltransfe | 2.8 |
| 104257 | AF006265 | Hs.9222 | estrogen receptor-binding fragment-associated | 2.8 |
| 116204 | AA465701 | Hs. 108646 | ESTs | 2.8 |
| 125914 | AA262925 | Hs. 180034 | cleavage stimulation factor: 3' pre-RNA, subu | 2.8 |
| 131510 | AA207114 | Hs. 27842 | ESTs, Weakly similar to similar to 1-acyl-gly | 2.8 |
| 106291 | AA435551 | Hs. 30824 | ESTs | 2.8 |
| 122761 | AA459296 | Hs. 105039 | ESTs; Weakly similar to !!!! ALU SUBFAMILY J | 2.8 |
| 107056 | AA600310 | Hs.18720 | programmed cell death 8 (apoptosis-inducing f | 2.8 |
| 108535 | AA084505 | Hs.226440 | *Homo sapiens* clone 24881 mRNA sequence | 2.8 |
| 116226 | AA478729 | Hs. 76450 | ESTs | 2.8 |
| 120266 | AA173939 | Hs. 193902 | ESTs, Weakly similar to inner centromere prot | 2.8 |
| 128654 | H20689 | Hs. 103180 | actin-like 6 | 2.8 |
| 116726 | F13681 | Hs.42309 | ESTs | 2.7 |
| 132640 | U33821 | | Tax1 (human T-cell leukemia virus type I) bin | 2.7 |
| 133273 | AA147725 | Hs. 69469 | dendritic cell protein | 2.7 |
| 108846 | AA132983 | Hs. 44155 | DKFZP586G1517 protein | 2.7 |
| 105621 | AA280865 | Hs. 6375 | *Homo sapiens* mRNA; cDNA DKFZp564K0222 (from c | 2.7 |
| 129164 | AA282183 | Hs. 109045 | ESTs | 2.7 |
| 133618 | U78524 | Hs.75251 | DEAD/H (Asp-Glu-Ala-Asp/His) box binding prot | 2.7 |
| 120521 | AA258785 | Hs. 107476 | ATP synthase, H– transporting, mitochondrial | 2.7 |
| 116429 | AA609710 | Hs. 82837 | Human chromosome 3p21.1 gene sequence | 2.7 |
| 110984 | N52006 | Hs. 80120 | UDP-N-acetyl-alpha-D-galactosamine polypeptid | 2.7 |
| 100372 | D79997 | Hs. 184339 | KIAA0175 gene product | 2.7 |
| 125134 | W19228 | Hs. 100748 | ESTs | 2.7 |
| 129254 | AA453624 | Hs.1098 | deoxynucleotidyltransferase, terminal | 2.7 |
| 102339 | U37022 | Hs. 95577 | cyclin-dependent kinase 4 | 2.7 |
| 106589 | AA456646 | Hs. 28661 | ESTs | 2.7 |
| 119118 | R44122 | Hs. 42743 | ESTs, Weakly similar to predicted using Genef | 2.7 |
| 105973 | AA406320 | Hs. 21201 | DKFZP566B0846 protein | 2.7 |
| 106317 | AA436568 | Hs.172140 | ESTs | 2.7 |
| 115551 | AA365527 | Hs. 177861 | ESTs, Highly similar to CGI-110 protein [H.sa | 2.7 |
| 103789 | AA096178 | Hs. 70337 | immunoglobulin superfamily; member 4 | 2.7 |
| 105079 | AA143190 | Hs. 12677 | ESTs; Highly similar to CGI-147 protein [H.sa | 2.7 |
| 109299 | AA205649 | Hs.86371 | zinc finger protein 254 | 2.7 |
| 122089 | AA432136 | Hs. 98682 | ESTs | 2.7 |
| 129108 | L20321 | Hs. 1087 | serine/threonine kinase 2 | 2.7 |
| 129385 | D82675 | Hs. 110950 | *Homo sapiens* clone 25007 mRNA sequence | 2.7 |
| 131412 | U34044 | Hs. 124027 | SELENOPHOSPHATE SYNTHETASE, Human selenium d | 2.7 |
| 104052 | AA393164 | Hs. 97644 | mammaglobin 2 | 2.7 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
| --- | --- | --- | --- | --- |
| 116254 | AA481146 | Hs.41086 | ESTs, Weakly similar to OXYSTEROL-BINDING PRO | 2.7 |
| 106878 | AA488872 | Hs.12314 | *Homo sapiens* mRNA, cDNA DKFZp586C1019 (from c | 2.7 |
| 114652 | AA101416 | Hs. 107149 | ESTs, Weakly similar to PTB-ASSOCIATED SPLICI | 2.7 |
| 106831 | AA482014 | Hs. 29463 | centrin, EF-hand protein; 3 (CDC31 yeast homo | 2.7 |
| 101445 | M21259 | Hs. 1066 | small nuclear ribonucleoprotein polypeptide E | 2.7 |
| 124428 | N36881 | Hs.82202 | ribosomal protein L17 | 2.7 |
| 114471 | AA028074 | Hs. 103387 | ESTs | 2.7 |
| 102051 | U07550 | Hs. 1197 | heat shock 10 kD protein 1 (chaperonin 10) | 2.7 |
| 106916 | AA490814 | Hs.24170 | ESTs; Weakly similar to ribosomal S1 protein | 2.7 |
| 116142 | AA460649 | Hs. 39457 | ESTs | 2.7 |
| 109912 | H05509 | Hs. 24639 | ESTs | 2.7 |
| 103193 | X70476 | Hs.75724 | coatomer protein complex, subunit beta 2 (bet | 2.7 |
| 102046 | U07151 | Hs. 182215 | ADP-ribosylation factor-like 3 | 2.7 |
| 104567 | R64534 | Hs. 101469 | ESTs | 2.7 |
| 112996 | T23539 | Hs. 7165 | zinc finger protein 259 | 2.7 |
| 118138 | N57773 | Hs. 93560 | ESTs, Weakly similar to trg [*R.norvegicus*] | 2.7 |
| 123095 | AA485724 | Hs. 192119 | ESTs | 2.7 |
| 124315 | H94892 | Hs. 6906 | v-ral simian leukemia viral oncogene homolog | 2.7 |
| 124447 | N48000 | Hs.140945 | *Homo sapiens* mRNA, cDNA DKFZp586L141 (from cl | 2.7 |
| 132834 | H77546 | Hs. 57898 | ESTs, Highly similar to NY-REN-49 antigen [H | 2.7 |
| 107529 | Y12065 | Hs. 5092 | nucleolar protein (KKE/D repeat) | 2.7 |
| 130648 | AA075427 | Hs.17296 | ESTs, Weakly similar to /prediction | 2.7 |
| 106685 | AA461551 | Hs. 16251 | ESTs; Highly similar to 73 kDA subunit of cle | 2.6 |
| 133848 | AA093287 | Hs. 76728 | ESTs | 2.6 |
| 134880 | AA092376 | Hs. 90606 | 15 kDa selenoprotein | 2.6 |
| 128871 | AA400271 | Hs. 106778 | *Homo sapiens* mRNA for putative Ca2+ transport | 2.6 |
| 106846 | AA485223 | Hs. 34892 | ESTs | 2.6 |
| 119892 | W84548 | Hs.94896 | ESTs | 2.6 |
| 132309 | AA460917 | Hs. 2780 | Jun D proto-oncogene | 2.6 |
| 132923 | U21858 | Hs. 60679 | TATA box binding protein (TBP)-associated fac | 2.6 |
| 114365 | Z41688 | Hs. 18653 | ESTs | 2.6 |
| 114162 | Z38909 | Hs. 22265 | ESTs | 2.6 |
| 133370 | AA156897 | Hs. 72157 | DKFZP56411922 protein | 2.6 |
| 106818 | AA480890 | Hs. 3542 | ESTs | 2.6 |
| 133501 | W16684 | Hs. 74284 | ESTs; Moderately similar to Similar to S cere | 2.6 |
| 100530 | HG1869-HT1904 | | Male Enhanced Antigen | 2.6 |
| 130553 | AA430032 | Hs. 252587 | pituitary tumor-transforming 1 | 2.6 |
| 108917 | AA137078 | Hs. 173648 | ESTs | 2.6 |
| 122249 | AA436679 | Hs. 258543 | ESTs, Highly similar to CGI-07 protein [H.sap | 2.6 |
| 119598 | W45531 | Hs.94642 | ESTs | 2.6 |
| 119902 | W84865 | Hs. 40094 | Human DNA sequence from clone 167A19 on chrom | 2.6 |
| 133272 | AA465016 | Hs. 69423 | kallikrein 10 | 2.6 |
| 132575 | AA045365 | Hs. 5188 | ESTs; Weakly similar to 60S RIBOSOMAL PROTEIN | 2.6 |
| 130459 | AA460264 | Hs.155983 | KIAA0677 gene product | 2.6 |
| 133083 | N70633 | Hs. 6456 | chaperonin containing TCP1, subunit 2 (beta) | 2.6 |
| 131130 | T19399 | Hs. 23255 | nucteoporin 155 kD | 2.6 |
| 112043 | R43317 | Hs. 26312 | glioma amplified on chromosome 1 protein (leu | 2.6 |
| 116146 | AA460701 | Hs. 193200 | ESTs | 2.6 |
| 122378 | AA446100 | Hs. 103617 | ESTs | 2.6 |
| 103134 | X65724 | Hs. 2839 | Norrie disease (pseudoglioma) | 2.6 |
| 133395 | AA491296 | Hs. 72805 | ESTs | 2.6 |
| 115652 | AA405098 | Hs.38178 | ESTs | 2.6 |
| 104975 | AA086071 | Hs. 50758 | chromosome-associated polypeptide C | 2.6 |
| 134691 | M59789 | Hs. 88474 | prostaglandin-endoperoxide synthase 1 (prosta | 2.6 |
| 112869 | T03313 | Hs. 4747 | dyskeratosis congenita 1; dyskerin | 2.6 |
| 100092 | AF000231 | Hs.75618 | RAB11A, member RAS oncogene family | 2.6 |
| 102635 | U66838 | Hs. 79378 | cyclin A1 | 2.6 |
| 104490 | N71503 | Hs. 43087 | ESTs; Weakly similar to dysferlin [*H. sapiens*] | 2.6 |
| 106813 | AA479922 | Hs.181022 | ESTs | 2.6 |
| 106872 | AA487907 | Hs. 18282 | ESTs, Highly similar to unknown [*H. sapiens*] | 2.6 |
| 107022 | AA599041 | Hs. 28866 | programmed cell death 10 | 2.6 |
| 107113 | AA610073 | Hs. 23900 | ESTs; Weakly similar to oligophrenin-1 like p | 2.6 |
| 113281 | T66300 | Hs.112356 | mRNA for lipoyltransferase; comp | 2.6 |
| 115586 | AA399218 | Hs. 92423 | ESTs | 2.6 |
| 115779 | AA424183 | Hs. 70945 | ESTs | 2.6 |
| 122895 | AA469946 | Hs. 105325 | ESTs | 2.6 |
| 124726 | R15740 | Hs.104576 | carbohydrate (keratan sulfate Gal-6) sulfotra | 2.6 |
| 129775 | R94659 | Hs. 12420 | ESTs | 2.6 |
| 131991 | AA251909 | Hs. 36708 | budding uninhibited by benzimidazoles 1 (yeas | 2.6 |
| 132518 | D57975 | Hs. 5064 | ESTs | 2.6 |
| 134612 | AA451712 | Hs.171581 | ESTs, Highly similar to ubiquitin C-terminal | 2.6 |
| 130313 | AA620323 | Hs. 154320 | ubiquitin-activating enzyme E1C (homologous t | 2.6 |
| 131971 | R70167 | Hs. 3611 | ESTs | 2.6 |
| 133175 | AA134767 | Hs. 66666 | ESTs | 2.6 |
| 102083 | U10323 | Hs. 75117 | interleukin enhancer binding factor 2, 45 kD | 2.6 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 125670 | AI432621 | Hs.82685 | CD47 antigen (Rh-related antigen; integrin-as | 2.6 |
| 121822 | AA425107 | Hs. 97016 | ESTs; Moderately similar to SH3 domain-bindin | 2.6 |
| 106719 | AA465171 | Hs. 236844 | ESTs | 2.6 |
| 130029 | AA236412 | Hs. 236510 | ESTs; Moderately similar to PFT27 [*M. musculus* | 2.6 |
| 124328 | H97781 | Hs.14415 | ESTs, Highly similar to CGI-108 protein [H.sa | 2.6 |
| 105387 | AA236951 | Hs.108636 | chromosome 1 open reading frame 9 | 2.6 |
| 103073 | X59417 | Hs. 74077 | proteasome (prosome; macropain) subunit; alph | 2.6 |
| 116294 | AA489000 | Hs. 93748 | ESTs, Moderately similar to TRANSCRIPTION FAC | 2.6 |
| 135339 | D59269 | Hs.127842 | *Homo sapiens* mRNA full length insert cDNA clo | 2.6 |
| 125390 | H95094 | Hs.75187 | translocase of outer mitochondrial membrane 2 | 2.6 |
| 102504 | U52077 | Hs. 247948 | Human mariner1 transposase gene, complete con | 2.6 |
| 131076 | H44386 | Hs. 22666 | ESTs | 2.6 |
| 114096 | Z38342 | Hs. 27007 | chromosome condensation 1-like | 2.6 |
| 120402 | AA234339 | Hs. 50282 | GTP-binding protein ragB | 2.6 |
| 102125 | U14550 | Hs. 107573 | sialyltransferase | 2.6 |
| 134653 | AA452818 | Hs.87385 | ESTs | 2.6 |
| 101959 | S80343 | Hs. 180832 | arginyl-tRNA synthetase | 2.6 |
| 116766 | H13260 | Hs. 95097 | ESTs | 2.6 |
| 104954 | AA074514 | Hs. 26213 | ESTs, Weakly similar to protein [*H. sapiens*] | 2.5 |
| 108771 | AA127924 | Hs. 71034 | ESTs | 2.5 |
| 116439 | AA610068 | Hs.43913 | PIBF1 gene product | 2.5 |
| 133859 | U86782 | Hs. 178761 | 26S proteasome-associated pad1 homolog | 2.5 |
| 132792 | AA401903 | Hs. 242985 | hemoglobin, gamma G | 2.5 |
| 129620 | AA010686 | Hs. 239720 | ESTs; Weakly similar to KIAA0691 protein [H. s | 2.5 |
| 120296 | AA191353 | Hs.22385 | ESTs, Weakly similar to KIAA0970 protein [H. s | 2.5 |
| 115615 | AA401186 | Hs. 48617 | ESTs | 2.5 |
| 102983 | X17620 | Hs. 118638 | non-metastatic cells 1; protein (NM23A) expre | 2.5 |
| 106288 | AA435536 | Hs. 24336 | ESTs | 2.5 |
| 107444 | W28391 | Hs.5181 | proliferation-associated 2G4, 38 kD | 2.5 |
| 104525 | R16007 | Hs.75355 | ubiquitin-conjugating enzyme E2N (homologous | 2.5 |
| 128917 | AA204876 | Hs. 206097 | oncogene TC21 | 2.5 |
| 102299 | U32907 | Hs. 155545 | 37 kDa leucine-rich repeat (LRR) protein | 2.5 |
| 115363 | AA282071 | Hs. 152759 | activator of S phase kinase | 2.5 |
| 130399 | AA449417 | Hs. 155356 | *Homo sapiens* mRNA for putative glucosyltransf | 2.5 |
| 130752 | D50927 | Hs.18895 | tousled-like kinase 1 | 2.5 |
| 132724 | AA417962 | Hs. 55498 | geranylgeranyl diphosphate synthase 1 | 2.5 |
| 106743 | AA476352 | Hs. 21938 | ESTs, Weakly similar to KIAA0704 protein [H.s | 2.5 |
| 128949 | AA190993 | Hs. 8850 | a disintegrin and metalloproteinase domain 12 | 2.5 |
| 125685 | AI040346 | Hs.4943 | hepatocellular carcinoma associated protein, | 2.5 |
| 105826 | AA398243 | Hs. 21806 | ESTs; Moderately similar to similar to NEDD-4 | 2.5 |
| 110841 | N31610 | Hs. 18645 | ESTs, Weakly similar to partial CDS [C.elegan | 2.5 |
| 111987 | R42036 | Hs. 6763 | KIAA0942 protein | 2.5 |
| 132669 | AA188378 | Hs. 54602 | ESTs; Weakly similar to 60S RIBOSOMAL PROTEIN | 2.5 |
| 100398 | D84557 | Hs.155462 | minichromosome maintenance deficient (mis5; S | 2.5 |
| 130800 | AA223386 | Hs. 19574 | ESTs; Weakly similar to katanin p80 subunit [ | 2.5 |
| 114481 | AA033562 | Hs. 151572 | ESTs | 2.5 |
| 113404 | T82323 | Hs. 70337 | immunoglobulin superfamily, member 4 | 2.5 |
| 100260 | D38491 | Hs. 174135 | KIAA0117 protein | 2.5 |
| 103563 | Z22534 | Hs.150402 | activin A receptor, type I | 2.5 |
| 104573 | R68952 | Hs.29780 | ESTs | 2.5 |
| 105025 | AA126336 | Hs. 22744 | ESTs, Weakly similar to ZINC FINGER PROTEIN 1 | 2.5 |
| 105524 | AA258158 | Hs.22153 | ESTs; Weakly similar to KIAA0352 [*H. sapiens*] | 2.5 |
| 106157 | AA425367 | Hs. 32094 | ESTs | 2.5 |
| 107243 | D59489 | Hs. 34727 | ESTs | 2.5 |
| 109920 | H05733 | Hs. 30558 | ESTs | 2.5 |
| 109981 | H09552 | Hs. 26090 | ESTs, Weakly similar to T20B12 1 [*C. elegans*] | 2.5 |
| 114518 | AA046407 | Hs. 106469 | suppressor of var1 (S cerevisiae) 3-like 1 | 2.5 |
| 114768 | AA149007 | Hs.182339 | Ets homologous factor | 2.5 |
| 118906 | N91000 | Hs. 94433 | ESTs | 2.5 |
| 119025 | N98926 | Hs. 55209 | ESTs, Weakly similar to DMR-N9 PROTEIN [H.sap | 2.5 |
| 131712 | N29502 | Hs. 30991 | KIAA0957 protein | 2.5 |
| 132233 | X04706 | Hs.93574 | homeo box D3 | 2.5 |
| 132740 | AA227751 | Hs. 55896 | ESTs | 2.5 |
| 115239 | AA278650 | Hs. 73291 | ESTs, Weakly similar to similar to the beta t | 2.5 |
| 128820 | F10338 | Hs.106309 | Friend of GATA2 | 2.5 |
| 124049 | F10523 | Hs. 74519 | primase, polypeptide 2A (58 kD) | 2.5 |
| 128781 | X85372 | Hs. 105465 | small neclear ribonucleoprotein polypeptide F | 2.5 |
| 121361 | AA405494 | Hs. 183052 | ESTs | 2.5 |
| 134133 | X93920 | Hs. 180383 | dual specificity phosphatase 6 | 2.5 |
| 102502 | U51678 | Hs.78050 | small acidic protein | 2.5 |
| 115875 | AA433943 | Hs.43946 | ESTs, Weakly similar to Weak similarity to Ye | 2.5 |
| 132874 | AA425776 | Hs. 58609 | ESTs | 2.5 |
| 109646 | F04543 | Hs. 5028 | DKFZP564O0423 protein | 2.5 |
| 111197 | N68093 | Hs. 22909 | ESTs | 2.5 |
| 102968 | X16396 | Hs. 154672 | methylese tetrahydrofolate dehydrogenase (NAD | 2.5 |

TABLE 7A-continued

ABOUT 770 UP-REGULATED GENES, OVARIAN CANCER VERSUS NORMAL ADULT TISSUES

| Pkey | Ex. Accn | UG ID | Title | ratio |
|---|---|---|---|---|
| 124911 | R88992 | Hs. 123645 | ESTs | 2.5 |
| 106628 | AA459657 | Hs. 12311 | Homo sapiens close 23570 mRNA sequence | 2.5 |
| 116988 | H82527 | | ys69e12.s1 Soares retina N2b4HR Homo sapiens | 2.5 |
| 131075 | Y00757 | Hs. 2265 | secretory granule; neuroendocrine protein 1 ( | 2.5 |
| 133578 | X78627 | Hs. 75066 | translin | 2.5 |
| 100420 | D86983 | Hs.118893 | p53-responsive gene 2 | 2.5 |
| 130743 | W87710 | Hs. 18724 | Homo sapiens mRNA, cDNA DKFZp564F093 (from cl | 2.5 |
| 122465 | AA448164 | Hs. 99153 | ESTs, Highly similar to CGI-73 protein [H.sap | 2.5 |
| 115117 | AA256492 | Hs. 49007 | poly(A) polymerase | 2.5 |
| 124582 | N68477 | Hs. 108408 | ESTs; Highly similar to CGI-78 protein [H.sap | 2.5 |
| 104771 | AA025911 | Hs.24994 | ESTs; Highly similar to CGI-53 protein [H.sap | 2.5 |
| 108059 | AA043944 | Hs. 62663 | ESTs | 2.5 |
| 105628 | AA281251 | Hs. 35696 | ESTs, Weakly similar to putative zinc finger | 2.5 |
| 109261 | AA195255 | Hs. 61779 | ESTs | 2.5 |
| 119789 | W73140 | Hs. 50915 | kallikrein 5 | 2.5 |
| 130512 | AA045304 | Hs. 181271 | ESTs; Highly similar to CGI-120 protein [H.Sa | 2.5 |
| 134402 | U25165 | Hs.82712 | fragile X mental retardation, autosomal homol | 2.5 |
| 104769 | AA025887 | Hs. 114774 | ESTs, Weakly similar to !!!! ALU SUBFAMILY J | 2.5 |
| 125787 | AA744748 | Hs. 29403 | ESTs, Weakly similar to PROBABLE ATP-DEPENDEN | 2.5 |
| 131775 | AA459555 | Hs. 31921 | KIAA0648 protein | 2.5 |

Pkey: Primekey
Ex. Accn. Exemplar Accession
UG ID UniGene ID
Title: UniGene Title
ratio: ration tumor vs normal tissues

TABLE 7B

| Pkey | CAT Number | Accession |
|---|---|---|
| 101335 | 46413_1 | L49054 N87447 AA248791 AA452193 AI015525 AI762070 AA781526 AW183498 AA625682 AI268713 AA400391 AI193725 AW590304 W56360 AA936067 AI990398 AA406183 AA628888 AA844206 AA621117 AI141092 AI808150 BE379750 AI351482 AA093527 AA405119 AA400562 AW368723 AA463811 AW242927 R50034 W56334 F21257 AA164314 BE074125 AA470924 AI307439 W16738 AA026647 T35999 T19178 AA164313 AI744010 AI015466 AI014921 |
| 100906 | 4312_1 | AU076916 BE298110 AW239395 AW672700 NM_003875 U10860 AW651755 BE297958 C03806 AI795876 AA644165 T36030 AW392852 AA446421 AW881866 AI469428 BE548103 T96204 R94457 N78225 AI564549 AW004984 AW780423 AW675448 AW087890 AA971454 AA305698 AA879433 AA535069 AI394371 AA928053 AI378367 N59764 AI364000 AI431285 T81090 AW674657 AW674987 AA897396 AW673412 BE063175 AW674408 AI202011 R00723 AI753769 AI460161 AW079585 AW275744 AI873729 D25791 BE537646 T81139 R00722 |
| 102221 | 3861_1 | NM_006769 U24576 AW161961 AW160473 AW160465 AW160472 AW161069 AI824831 AW162635 AI990356 AW162477 AW162571 AI520836 AW162352 AW162351 AW162752 AI962216 AI537346 AA853902 H17667 BE045346 BE559802 BE255391 AA985217 AA235051 AI129757 AW366451 T34489 D56106 D56351 AI936579 AW023219 AW889335 AW889120 AW889232 AW889175 BE093702 AW889349 AA147546 AI952998 AA912579 AI143356 AW902211 R64717 AW157236 AI815242 D45274 AW263991 AA442920 AA129965 AL035713 AI923255 AI949082 AI142826 AI684160 AI701987 AI678954 AI827349 BE463635 AW628092 AW302281 AA493203 BE348856 BE536419 AW193969 AW673561 AW592609 AI224044 H43943 AA091912 R49632 R48353 AI568409 R48256 AI198046 H27986 H43899 AI678759 AI680310 AI624220 H17052 AA156410 N56062 AI699430 AA664529 T09406 T10459 AA627506 AI379584 N83831 N88633 AW022651 AA971281 AA248036 AI039197 AI914689 AA973825 AL047305 AA129966 AI798369 AW264348 AI445879 AI658759 N67924 AI933507 AI216121 AI333174 T10972 AI375028 AI186756 AI273778 AA610487 AI797946 AA853903 AA903939 AI338587 AI278494 AW627595 AA904019 |
| 101714 | 30725_1 | M68874 AL022147 M72393 AL049797 BE439441 T27650 AI766240 AW150345 AW778943 AI627464 BE439479 AA587049 AI277900 AI984983 AI630935 |
| 116803 | 55078_4 | H47357 W33034 H55976 H55975 R67830 AA527091 F24482 AW841585 R66514 |
| 116988 | 185904_1 | AW953679 AW953680 AA244436 H82527 AA361046 AA244483 H82526 |

TABLE 7B-continued

| Pkey | CAT Number | Accession |
|---|---|---|
| 132640 | 179_1 | AW162087 AA224538 AA471218 AA088655 AA375275 BE440052 AF090891 AA324435 AF063549 AI10675 AA322223 AW953306 AA233590 AW949864 AW949859 AA383721 AA081878 U33821 NM_006024 AA350900 AA081588 AI148087 AF268075 AA088185 AI142478 AA081824 AI887930 AA070570 BE185248 AI459825 BE257794 AA420459 AA420859 AA777997 AA081219 AW815721 AW854758 AA157932 BE018208 AW378974 AL041212 AI247564 AW581897 AI002897 BE543242 AI811690 AW852076 AW852270 AA360969 AA094943 AA090680 AW601554 AA099673 AA662226 AA356814 AA330174 AA187544 C02751 AA315460 BE168358 AW080447 AI813764 AI624222 AW156901 AI954032 AW473780 AI861975 AA173643 AW511541 AI951492 BE301686 AA669760 BE182212 AA081009 T69431 AI186207 AA604124 AA707346 AA173953 AI016700 AI125916 AA358962 AI673719 T90593 T90497 T10776 AW513002 AW304292 AA724885 AW474759 AI811621 AW068925 AA666305 AI580161 AI128023 AW471151 AA534849 AA666358 AI078833 AI139223 AI244874 AI381658 AW263441 AI432440 AW802882 N66401 A224251 AI167469 AI141060 AA099214 AI537130 AL120428 AA948655 D53110 AA076099 AA938617 AA826543 AI357914 AA565098 AA807994 AI288812 AA632832 AA157933 AA639802 AA634268 AA282337 AA551431 AA557374 AA256923 AA872943 AA009665 H89626 AA810386 T92925 T36145 AA632190 AA130436 AI686635 AA130437 AW392904 AW392839 AW392848 AW392836 AA729737 AA070450 AW392890 W04825 AA771848 AA084634 AA481985 AI263840 AI801006 AA235380 AI954229 AI559330 AI208724 AA887638 T25894 AA041269 W44443 AI581770 W46171 AA878485 W46535 AA197336 AA894945 AA394224 AI766834 AI582590 AI033007 AA481889 AW190598 AW392855 R27279 AA398137 AI248407 AI241386 AI991753 AI826585 AA865699 AI096806 AI833030 AA041279 AW888745 AI703279 N70572 AI912553 BE549931 AI240422 AW376187 AW591692 AA975905 AW614967 AA009666 W44332 AA664659 T06561 BE468150 AI650695 AA587920 AI473310 AI032991 AA256499 AW104241 BE163782 AI984973 BE163613 AI263906 AA628191 AA282072 BE163769 BE163775 AI492939 AI473315 D56907 AA587930 H89480 AI362373 AA598483 D56595 AI167590 C16223 AI935415 D62555 D62884 D63130 AI760286 AI650286 AW173598 AI499145 AI122566 AW903408 AI810569 AA854936 BE049510 D62065 D61900 D62101 R27475 AI469835 AI669086 N80399 N48922 N48746 AA481381 R22858 H13912 AC004549 AW602500 AW768788 |
| 103427 | 43892_1 | BE514383 AA071273 AW247987 AW673286 BE312102 AW749824 BE071985 AW577383 BE071945 BE072005 AW577355 BE071965 AW239231 BE072000 BE071960 AW577360 AW749830 AW373020 X97303 AW999522 BE000192 BE562219 BE266655 BE264970 |
| 103631 | 152_34 | R64730 AF214731 T19173 BE258318 AF161446 BE542228 BE383856 BE206748 BE543260 AA640735 AA788907 BE251313 BE221852 AW855357 AA224407 AW855346 BE150454 AW070651 BE326867 AW051698 AI829278 AI470927 AW855345 AI804942 AI971004 BE046620 AI863664 AA808492 AI915971 BE046949 AW590711 AI468066 BE409685 AA332653 BE385394 AA852623 BE255591 BE254968 AA211871 BE255493 BE257727 BE255389 BE257491 BE262528 BE261296 BE313277 BE261714 BE314316 Z28434 AA315545 BE008562 BE012093 BE161393 T31969 AA305848 AW955238 BE619156 AI191748 AA323396 AW361760 AA216118 BE264939 AA325954 AW580281 AA302597 AW888908 AW888893 BE312970 AA134402 H52679 AA478191 T34090 AW961505 Z24771 AA179552 R57244 BE315207 AW583121 AI372747 T33143 AW377460 T33141 R14922 AW352414 H93249 AW405576 T33102 R89545 N46625 H08434 BE165062 AW367891 H93121 H47325 T30931 AW402852 H47410 Z20368 T18928 T30758 H93254 AW389725 R96628 AI372407 R88995 AI815980 AW157278 AW607664 AW163288 AA133492 AA099328 AA157348 AI816063 AW449556 AA157252 AW608980 H66576 AW821127 T32030 AW856058 AA032188 Z42120 R18582 AW402392 BE408021 AA280989 AA039427 AA035354 AW328008 T94186 R97481 AA181444 AA774697 BE613141 AW630221 H13066 AI124578 AW754481 BE262112 AW839942 H60108 AW364002 AW363800 BE547161 BE082634 AA642471 BE619719 BE082719 W28879 AW794944 C01685 AI291127 AW166099 AI936102 AI478929 R70284 AA872914 W31065 N54216 AI568741 H56262 NM_017425 Z48570 AI831777 T75007 AA354867 AA427988 AI922844 AA733170 AW821145 BE081547 AW881571 AW881573 AW055249 AA204724 AI417415 AI127303 AI355013 AI039527 AW593259 AA576745 AI457317 AW593236 H93126 BE396072 AL134941 AI424011 AA115732 AA179986 AI334944 AW367922 AW152304 AA806752 AI312418 AW935023 BE301136 AA032258 AI829922 AI372406 BE177074 AW513743 AI151526 AA975643 AA478034 AI814920 AW080063 AI032624 BE177107 AA319768 AW935098 AI017620 AA974477 D51441 C14225 AL043583 D80145 AI690771 AW009711 AW881570 |

TABLE 7B-continued

| Pkey | CAT Number | Accession |
|---|---|---|
| | | AI220431 N51090 AI143003 AA961480 AA039351 AI094885 AI096520 AI179553 AA593974 AI373929 AA677252 AA687374 AA886867 AA312863 AI150654 AI138450 AA133209 H99368 AI565632 AW070496 AI539748 H59455 AI811537 H52680 T74907 AI499657 R96670 AA854796 AA427863 AA224345 AA889899 AI347782 AA931056 AI076059 AI360841 AI797975 AI362268 AI200968 BE350785 R97433 N98499 AA134403 AA035355 AW263162 AI369607 D80144 AI376627 AI520801 AA365942 AI707705 AI123495 T33101 H08716 AA804238 AA922201 AA723522 AW183592 AI445884 F34614 AW022342 AA363998 AA568793 AA152475 D31233 AA852622 AA099862 AI129147 AA922699 AA782664 T33142 T30009 T32913 AI676138 AI914657 N34899 AI372746 AI265911 AI352444 AA443158 AA910603 AI420273 AA868050 AI277700 C14224 AW082087 R41447 Z38385 AI911845 AI961888 R91976 F04560 AA661955 AI857675 AA369666 AA424207 N79953 AA382958 AA894626 AI884964 AA846989 AA215454 AI742580 AI339437 AI806879 AI091373 AA782558 AI026868 AW590904 AW204599 BE348235 AI819318 AA122324 AA939221 AW139711 AA131608 AW613548 AA122286 AI309179 AA437247 AW339322 AI671306 AW439848 AA131701 AI078075 N64624 AA812881 AI140547 |
| 129097 | 25953_1 | BE243933 AA355449 T29766 F08396 N83324 NM_006963 S50223 AI207648 AA258092 AA113952 AI311718 AI128612 AW607449 M77172 AI951311 X52346 AA903307 AI569810 N55421 W77876 R37223 R83788 AA031666 H47092 AA133451 AA311095 AA906963 H87667 N56058 AA393593 W24864 H10710 F06925 F07239 AW386140 AA325018 AA235950 AW373176 N57158 AA258093 N39467 R21609 BE089979 R34173 AW889005 AA745644 AI693852 AA424914 AA744771 W72632 AI291213 AA524318 AI472134 AI911230 AA528418 AA115745 AA775720 AI671134 AA975044 AW298117 AA321015 N26288 AW952194 AI743379 AI204233 AI801026 AA830690 AI146980 AW104611 AI338576 R21507 AI367623 BE244484 AI269308 AA031667 AI884346 AA731989 AA988943 AA235951 AA807887 AA642645 AI246489 N29739 AI216718 AI383349 AI038618 AI351476 AA806031 AI914178 H10711 AI095573 H89220 AW470854 AA729015 R83353 AA782239 R34295 H87165 AW419059 AI653689 Z40349 H89114 AW074506 AA397785 AA888377 AI911228 F03193 AI468783 AA702615 AI830829 AA748323 R37224 AA424915 AA731647 H47183 |
| 120695 | 9683_3 | AA976503 AI917802 AA953664 AA404613 AA428771 BE280542 AW194691 AI927301 AI740458 AI796100 AI935603 AW052210 AA970201 AI633384 AA425910 AI017004 AI241295 AA402816 AA291468 |
| 100352 | 37786_1 | AL133887 D64159 AF112218 AI766633 AL039303 AL133888 BE620604 AW976259 AW262792 AW591383 AI365413 N36652 AA807027 AI472041 BE620065 |
| 101084 | 13883_1 | AW409934 AW245855 AU077157 AW163245 AW161434 AW250083 AA316055 BE621134 AA171883 BE272494 L05425 BE250310 NM_013285 BE311494 AA858436 AA308223 AW362598 AA373618 BE394454 AA126101 AA581348 AA303227 AA058438 AA126544 AL135350 AW996947 AA403201 AA446682 W79685 AW246249 AW577783 AW002316 AA320025 AW753913 AI798554 AW070650 BE250413 AW250835 BE076336 AI925558 AI907634 AW804193 AW804270 AA902387 AW804232 AW804255 AW607751 AI909114 AW157242 AA934590 AI628921 AI470650 AW409935 AW172793 AA401208 AW162279 AA888018 BE206452 AI826742 AA857353 AA483614 AA126418 AA722289 AA780182 AW768894 AW183614 AW156969 AI244063 AA863491 AI376281 AA582490 AA846248 AI474094 AW246802 AA446557 AA126000 AI699045 AI702310 AI253092 AA171554 AA831455 AW118384 AI954511 AI760439 AI867001 AA493881 W81287 AA515590 AA659297 AA635139 AA659293 AA766044 AA196109 N32569 AI907635 |
| 100502 | 26409_1 | U15979 X17544 W52755 NM_003836 Z12172 AW370136 BE262564 T49116 AA333753 BE262238 BE313737 H38153 AW583056 R28890 BE259532 D16897 AA885610 AA911293 AA319627 R94472 R29022 AA443405 R96397 W04904 W01746 W01204 N74203 N58621 AA701996 AW418723 N53220 AA602813 AA576129 AA593786 AA911577 AA575957 AI149135 AW573058 AA772985 AI188918 AI372065 AA575838 W60010 AI004576 AI131265 AA319845 T50070 AI335742 AA235245 W32706 AA447372 R96355 N59573 AA904616 AI291224 BE467454 T49117 AI268620 AA928248 AA449494 AA318817 T49929 R94473 H38154 AI076649 AW935307 AW605112 AW935433 AW935342 AW935310 AW935345 AI298308 AW935395 AW935384 AI184857 AA319871 T29465 C21134 Z19785 AA329107 T52079 AW935346 C06234 AI951555 T49928 AA371745 AA369296 AA346673 R82547 T50006 |
| 102398 | entrez_U42359 | U42359 |

Pkey: Unique Eos probeset identifier number
CAT number: Gene cluster number
Accession Genbank accession numbers TABLE 8A lists about 54 genes up-regulated in ovarian cancer compared to normal adult tissues These were selected from 35403 probesets on the Affymetrix/Eos-Hu01 Gene-Chip array such that the ratio of "average" ovarian cancer to "average" normal adult tissues was greater than or equal to 4.0 The "average" ovarian cancer level was set to the 3rd highest amongst various ovarian cancers. The "average" normal adult tissue level was set to the 4th highest amongst various non-malignant tissues. In order to remove gene-specific background levels of non-specific hybridization, the 15th percentile value amongst the non-malignant tissues was subtracted from both the numerator and the denominator before the ratio was evaluated

TABLE 8A

ABOUT 54 UP-REGULATED GENES, OVARIAN CANCER VERSUS NORMAL ADULT TISSUES

| Pkey | Ex. Accn | UG ID | Title | ratio |
|---|---|---|---|---|
| 130941 | D49394 | Hs. 2142 | 5-hydroxytryptamine (serotonin) receptor 3A | 12.1 |
| 101249 | L33881 | Hs. 1904 | protein kinase C, iota | 11.8 |
| 132528 | AA283006 | Hs. 50758 | chromosome-associated polypeptide C | 11.5 |
| 102610 | U65011 | Hs.30743 | preferentially expressed antigen in melanoma | 11.0 |
| 115536 | AA347193 | Hs. 62180 | ESTs | 10.0 |
| 129571 | X51630 | Hs. 1145 | Wilms tumor 1 | 9.3 |
| 105298 | AA233459 | Hs. 26369 | ESTs | 7.8 |
| 121779 | AA422036 | Hs. 98367 | ESTs | 7.3 |
| 104301 | D45332 | Hs. 6783 | ESTs | 6.9 |
| 132191 | AA449431 | Hs. 158688 | KIAA0741 gene product | 6.7 |
| 102136 | U15552 | Hs. 85769 | acidic 82 kDa protein mRNA | 6.6 |
| 101804 | M86699 | Hs.169840 | TTK protein kinase | 6.5 |
| 132572 | AA448297 | Hs. 237825 | signal recognition particle 72 kD | 5.9 |
| 106738 | AA470145 | Hs. 25130 | ESTs | 5.8 |
| 108857 | AA133250 | Hs.62180 | ESTs | 5.8 |
| 115291 | AA279943 | Hs. 122579 | ESTs | 5.8 |
| 132632 | N59764 | Hs. 5398 | guanine-monophosphate synthetase | 5.8 |
| 116401 | AA599963 | Hs.59698 | ESTs | 5.7 |
| 132725 | L41887 | Hs. 184167 | splicing factor, arginine/serine-nch 7 (35 kD | 5.7 |
| 129097 | S50223 | | HKR-T1=Kruppel-like zinc finger protein [huma | 5.6 |
| 134520 | N21407 | Hs. 257325 | ESTs | 5.5 |
| 108778 | AA128548 | Hs.90847 | general transcription factor IIIC, polypeptid | 5.4 |
| 131228 | AA279157 | Hs. 24485 | chondroitin sulfate proteoglycan 6 (bamacan) | 5.2 |
| 116238 | AA479362 | Hs. 47144 | DKFZP586N0819 protein | 5.2 |
| 108055 | AA043562 | Hs. 62637 | ESTs | 5.1 |
| 132939 | U76189 | Hs. 61152 | exostoses (multiple)-like 2 | 5.1 |
| 115909 | AA436666 | Hs. 59761 | ESTs | 5.0 |
| 120438 | AA243441 | Hs. 99488 | ESTs; Weakly similar to ORF YKR074w [S.cerevi | 5.0 |
| 123494 | AA599786 | Hs.112110 | ESTs | 5.0 |
| 109648 | F04600 | Hs. 7154 | ESTs | 4.9 |
| 132624 | AA164819 | Hs. 53631 | ESTs | 4.9 |
| 111234 | N69287 | Hs. 21943 | ESTs; Weakly similar to ORF YGL221c [S.cerevi | 4.9 |
| 135242 | M74093 | Hs.9700 | cyclin E1 | 4.9 |
| 123005 | AA479726 | Hs. 105577 | ESTs | 4.8 |
| 116296 | AA489033 | Hs. 62601 | *Homo sapiens* mRNA; cDNA DKFZp586K1318 (from c | 4.7 |
| 100661 | HG2874-HT3018 | | Ribosomal Protein L39 Homolog | 4.6 |
| 111345 | N89820 | Hs.14559 | ESTs | 4.6 |
| 102627 | U66561 | Hs. 158174 | zinc finger protein 184 (Kruppel-like) | 4.5 |
| 106459 | AA449741 | Hs.4029 | glioma-amplified sequence-41 | 4.5 |
| 102305 | U33286 | Hs. 90073 | chromosome segregation 1 (yeast homolog)-like | 4.5 |
| 129229 | AA211941 | Hs. 109643 | polyadenylate binding protein-interacting pro | 4.5 |
| 130376 | R40873 | Hs. 155174 | KIAA0432 gene product | 4.4 |
| 120619 | AA284372 | Hs. 111471 | ESTs | 4.4 |
| 122802 | AA460530 | Hs. 256579 | ESTs | 4.4 |
| 116416 | AA609219 | Hs.39982 | ESTs | 4.3 |
| 115094 | AA255921 | Hs. 88095 | ESTs | 4.2 |
| 126802 | A4947601 | Hs. 97056 | ESTs | 4.2 |
| 126892 | AI160190 | Hs.76127 | hect (homologous to the E6-AP (UBE3A) carboxy | 4.2 |
| 105516 | AA257971 | Hs. 21214 | ESTs | 4.1 |
| 131985 | AA434329 | Hs. 36563 | ESTs | 4.1 |
| 114965 | AA250737 | Hs.72472 | ESTs | 4.0 |
| 120821 | AA347419 | Hs. 96870 | *Homo sapiens* mRNA full length insert cDNA clo | 4.0 |
| 134621 | L02547 | Hs. 172865 | cleavage stimulation factor, 3' pre-RNA, subu | 4.0 |
| 134161 | U97188 | Hs. 79440 | IGF-II mRNA-binding protein 3 | 4.0 |

Pkey: Primekey
Ex. Accn Exemplar Accession
UG ID UniGene ID
Title: UniGene Title
ratio: ration tumor vs normal tissues

TABLE 8B

| Pkey | CAT Number | Accession |
|---|---|---|
| 101249 | 2520_1 | L18964 NM_002740 L33881 AA095249 BE080871 AW605320 |
| | | M85571 AA179776 AA160650 AW117327 BE467131 AW088338 AW937631 |
| | | AW087514 AI480090 AI873147 T57875 AI217404 AA827196 AI279471 |
| | | AA969093 AA815168 AA988896 AI754623 T28044 AW950302 |
| | | AW950294 AI032193 AI953696 AI630583 AA062633 BE541355 |
| | | AA180493 AW015748 AA255651 |
| 100661 | 23182_1 | BE623001 L05096 AA383604 AW966416 N53295 AA460213 AW571519 AA603655 |
| 116401 | 95855_1 | AW893940 AW978851 AA034240 AI686323 AI767653 AA829515 AA053933 |
| | | AA737691 W92607 AW261869 AA835698 AA447216 AI623248 |
| | | Z21891 AA835700 AA599963 T20152 AA533167 |
| 116416 | 373989_1 | AW753676 R11789 AW001886 AA609219 AW780420 AI860557 AI280331 |
| | | AI334300 AI288870 AA669343 N29918 BE537790 AA934687 |
| | | H79075 N42970 R63752 |
| 132191 | 54683_4 | AA507576 AI610269 AI380079 R40309 AI203932 AI342128 |
| | | AI342578 R43110 AW583269 AI375234 AI092708 R52802 AI1028462 AI016062 |
| | | AI189144 AI016691 W45515 AA551452 AA449431 T10046 AA424059 N62822 |
| | | AW197701 AA465242 AI418989 AI942433 AI891115 BE302316 |
| | | AI743979 AI283341 AW340338 AA774643 AW104778 AI078020 |
| | | N21487 H97562 AA970063 BE327945 F03880 F03885 AA970699 AI298468 |
| | | AI380330 AI247787 AA770467 AI200154 AI089863 AI089890 AI695738 |
| | | W88524 AI471010 AA700191 AA778937 BE440182 R79225 AA338236 |
| | | AA548984 AA907692 N21250 AW904736 AI909337 AA987772 AW959228 |
| | | AI149372 N29644 AI039967 AA677529 AA694291 R85811 N28672 |
| | | AA465598 AA321185 AW130492 AI824479 AI682992 |
| 130941 | 2774_1 | NM_000869 D49394 BE252349 AW249320 AW249140 AW250535 |
| | | S82612 AJ003079 AJ005205 AW178407 AA811360 AW976407 AW976408 |
| | | AW248903 AA731733 AA804189 AA703169 AI435492 AI076288 |
| | | AA912176 AW248713 AA743457 R08170 C06167 R02351 |
| 115909 | 47548_1 | AW872527 AA453863 AA442475 AF086541 |
| | | AA365801 AI692575 AW131631 AA732993 W96131 AA436666 AA453779 AA365504 AW959717 |
| | | AW975337 AA365503 AI632902 AA659686 AA665087 C00396 AA988869 |
| 108778 | 18565_1 | AF133123 NM_012086 AA128292 S81493 AL137453 BE614053 |
| | | AA307628 BE009521 BE085659 BE085542 BE085598 AL120654 R13165 |
| | | AA429306 R13465 R55236 AW994182 W00838 AW994417 AW994404 AW994426 |
| | | AW994321 AA516147 AA345603 AW953009 BE315104 |
| | | AI126654 AA626457 AA291327 H67983 H66271 H67976 AW270955 |
| | | AA758221 AI023487 AI921811 AI953370 AF085850 R70992 N25129 |
| | | AW295143 AI433661 AW608361 AA873402 AI217453 AI953358 |
| | | AA262143 AA928495 AI475268 AI167211 AW385961 AA259045 AI762630 |
| | | AA428238 AI001932 AI735550 AI951370 AA766807 S81492 AA918976 |
| | | AI040967 R70939 AA469065 T70340 AA477615 AA478070 AI017743 |
| | | AI608833 AI635824 AI186039 AA741312 AI040184 H67656 AA258221 |
| | | AA731316 AI381293 AW298473 R55237 R37375 AI768014 AA128548 |
| | | AI206773 AI879827 R64193 |
| 102136 | 17647_1 | AA300576 U15552 NM_014597 AA223318 AA171806 BE269461 |
| | | AW578439 AW604388 AW953513 AA772816 AW604383 AW577851 |
| | | BE169672 AW117711 AW366303 AW366302 AW366308 AW366304 |
| | | AW366300 AI908432 AW591937 AI358420 AW272622 C75067 AI926471 |
| | | AW002266 BE064947 BE064722 T10372 AW838681 AI811119 AW262098 |
| | | AA588547 AI916666 AI440083 AI078150 F24260 AA512919 |
| | | AI953413 AI064798 AI420425 AA191324 BE503222 AI632721 AA180035 |
| | | AA558329 W44843 T10610 W38442 BE542869 AI125024 BE279566 |
| | | AW747936 AI589491 AA559096 AA090265 AA548959 AA223220 AW515936 |
| | | AW368395 AW368407 BE540776 AI039762 AI584020 AA171691 |
| 108857 | 61_1 | AK001468 AA190315 AA374980 AW961179 AA307782 AA315295 AA347194 |
| | | AW953073 AW368190 AW368192 AA280772 AA251247 N85676 |
| | | AI215522 AI216389 N87835 R12261 R57094 AI660045 |
| | | AA347193 R16712 AW119006 N55905 N87768 AW900167 AI341261 AI818674 D20285 |
| | | AI475165 AA300756 R40626 AI122827 AA133250 AI952488 |
| | | AA970372 AA889845 AW069517 AI524385 AA190314 AI673359 AA971105 |
| | | AI351088 AI872789 AI919056 AI611216 AK001472 BE568761 AA581004 |
| 102305 | 18424_1 | AL043202 U33286 NM_001316 AF053641 AL048759 N99830 AA263091 AW408174 |
| | | N90467 R84306 AA317882 BE613644 AA307378 T10722 |
| | | AA207207 AA315560 AA113938 AW386317 AW386316 L44546 |
| | | AW386335 AA243317 AA713588 AA192541 AA649035 BE300737 AW752491 |
| | | AW902334 AW993922 BE003403 AA251521 AA382754 AA339152 AA382619 |
| | | H58600 H67810 T70379 T82109 D81644 D60375 H59003 |
| | | BE075732 AA471242 H17790 F11801 T84903 R78076 BE614356 R16380 |
| | | R16395 AA876127 W95535 AA164768 AI279876 H02142 C18698 |
| | | AA365866 AW954410 AI539769 T39128 AL121103 AA192466 AA213367 |
| | | AI963800 BE090601 Z20096 BE566508 AI969470 BE044090 T65536 |
| | | AA837311 AA075484 AA075621 AA778294 AA587266 T69722 AA446118 |
| | | X85624 AI334209 AI587101 AI281280 AA568602 AA946837 C75603 |
| | | AA236997 AA459274 AI150191 AA165156 AI198839 AA789258 AI139373 |
| | | AA236574 AI127770 AA678954 AI140786 AA113939 AI187231 |
| | | AI754062 AI753243 AA934719 AW439362 H02038 C17463 AI400951 |
| | | AA227539 N66040 R89384 AA872668 AI344110 W95420 AA164700 |

TABLE 8B-continued

| Pkey | CAT Number | Accession |
|---|---|---|
| | | C05669 BE094097 AI826398 H58956 T17222 AW139044 AI271344 |
| | | T16445 R42323 C75565 AA165228 AI025443 AA165229 C21496 AI826239 |
| | | AI868711 AA582354 AA524392 R01549 R01641 Z21083 AA528463 T39127 |
| | | AA989472 F09450 AA084485 BE004378 AW974353 AA137250 |
| | | AI278406 AW609291 AA137249 AA142866 AA639198 AW609271 |
| | | AW149760 AI025112 AA236620 AA937248 U90736 AW005487 AW674427 |
| | | BE397971 AW609285 T65602 T99684 T97378 AW609366 T85647 AI572235 |
| | | T99083 AA199583 AW303874 T35523 AA586445 Z39669 |
| | | AA459503 N95643 AW821210 AW813461 AW582064 AW609293 AW609320 |
| | | AW609270 AW582085 AW582071 AW609318 AW813451 |
| | | AW813456 AW582079 AW609276 AW609280 AW609290 AW582101 |
| | | AW582102 AW609263 AW609317 AW609256 AW609305 AW582063 |
| | | F06655 AW605343 AA446426 BE090595 AW969578 T79852 AI082505 |
| | | N63239 AI973168 AI086182 AA846711 AI874213 AA730605 AI927257 |
| | | AA912624 D60376 T10180 AA705847 AI018123 AA493197 T67083 |
| | | R77739 AA953087 R00885 AI370606 R01642 AA862914 N57843 |
| | | AW023353 H77483 H68082 R42337 H58601 T97267 |
| 109648 | 708849_1 | H17800 AI362549 AI671064 T23526 F03426 F04694 F04600 AI635856 Z38715 |
| | | F02039 AW022635 |
| 132528 | 11027_8 | T78736 AA284422 AA283006 |
| 101804 | 26687_1 | M86699 NM_003318 AL133475 AA122377 Z21415 R57092 AA806569 |
| | | AA811904 BE538323 R41558 AA421620 AI337292 AA470077 |
| | | AW795371 AA543024 AI677941 AI472200 AI215042 AA732384 |
| | | AA837143 AA804229 AI907533 AI742701 AA121159 AI973225 AI620839 |
| 132572 | 31281_1 | AI929659 AA227827 AF069765 AW408768 NM_006947 AF077019 AA220974 H07969 |
| | | C14621 D52294 BE512960 BE614138 BE258539 |
| | | BE251981 AA355433 AA481126 AW403053 BE542282 AI929818 AL120605 |
| | | AW753079 AW391834 BE018603 BE395262 W21406 AW663259 |
| | | AW975690 W93905 W96519 AI863832 AA443177 AA730942 T99558 |
| | | T86581 W19444 N55583 AI701020 AI928986 AI857864 AI590849 |
| | | AW081819 AA714970 AI122630 W04887 AW662427 AA602680 W93645 |
| | | AA582946 AW008812 AA311187 AA463631 AI421918 AI400518 |
| | | AI921404 AA143770 AA587675 BE302192 AA813080 AI493386 |
| | | AW327435 AW340871 AI143616 AA687231 AA218961 AI362249 AI378345 |
| | | N74716 AW969249 AA468581 AA516399 AI274726 AI131244 AI572604 |
| | | AI929236 AW327971 R65637 N90309 H07877 W96486 AI358806 |
| | | T90801 AI383246 AI740957 T86758 AI471248 AI864233 AA910590 |
| | | AI079094 AW805781 AA709025 AW196707 AW327436 AI903790 |
| | | AI873956 T99348 AI924643 AW103910 AI802993 AI080390 T99098 |
| | | D19794 AW327972 AI935904 AI288575 AW360875 AA779784 N93574 |
| | | AW769295 W32639 AA363094 N89012 W39751 AI291329 AI291371 |
| | | AA829411 AI985219 AI422775 AA918940 AA363108 AA192633 |
| | | AF086131 AA373679 AA165043 AA355705 AI243507 AI027796 AA573461 |
| | | AA757260 AI370979 AA574149 AA558276 N70650 AI478948 |
| | | R35393 AA448435 AA334659 AW879356 AA436527 AW972044 |
| | | W25165 AA521219 AI094141 AI302096 AW578551 AW578534 AW390535 |
| | | AI131472 N50381 AA736938 AI089112 AA863053 AI359793 |
| | | AA962268 T27353 D82590 AA448297 AI277168 AI368457 AA872737 AA330346 |
| | | AA308346 AA342341 AA355159 T85701 BE162893 T99703 |
| 131985 | 113870_1 | AA503020 AI858190 AI686571 AW615203 AW073686 AW172459 AI828762 |
| | | AW150534 AI859795 AA411046 AI539195 AA404609 AI638559 |
| | | AA434329 AA171844 AI684143 AA953518 AW470108 AI870700 |
| | | AA706376 AI539668 AI683712 AA075579 AI682137 AA291512 AA554431 |
| | | H51315 AA404225 AA075632 AA172293 H51911 |
| 132624 | 42095_1 | AA326108 W74020 AW612698 AI750909 AA487800 AJ270695 AA044941 H20708 |
| | | AA296750 AA018401 AA378581 AW964159 AA018887 |
| | | R68533 AA525338 AA526640 H84308 AA278942 AA164818 |
| | | AA847110 T82335 N25519 AA021474 N31381 N36297 AA838191 AA318932 |
| | | AA961206 N41430 N41439 AW630477 W37595 BE394538 |
| | | AA365256 N47771 N34873 AA988105 AI242138 AW148523 AI978761 N50882 |
| | | AA527448 AW086200 AI750910 N50868 AA709437 N51946 |
| | | AI222179 AA732883 H96742 AW615360 N53720 W37490 R87362 AA613273 |
| | | H98999 AI469022 AI368442 AI460122 N20486 N24087 AA164819 N24878 |
| | | AW471270 AW590458 R68240 AA594434 N20400 AI419626 |
| | | AW500664 AI033658 AA593215 AA907408 AA713508 AI422627 H85551 |
| | | AA923571 D62680 AW627456 H96206 AA016289 AA485896 N25691 |
| 132632 | 4312_1 | AU076916 BE298110 AW239395 AW672700 NM_003875 U10860 AW651755 |
| | | BE297958 C03806 AI795876 AA644165 T36030 AW392852 |
| | | AA446421 AW881866 AI469428 BE548103 T96204 R94457 |
| | | N78225 AI564549 AW004984 AW780423 AW675448 AW087890 AA971454 |
| | | AA305698 AA879433 AA535069 AI394371 AA928053 AI378367 |
| | | N59764 AI364000 AI431285 T81090 AW674657 AW674987 AA897396 |
| | | AW673412 BE063175 AW674408 AI202011 R00723 AI753769 AI460161 |
| | | AW079585 AW275744 AI873729 D25791 BE537646 T81139 R00722 |

TABLE 8B-continued

| Pkey | CAT Number | Accession |
|---|---|---|
| 102610 | 9336_1 | U65011 NM_006115 AW182053 BE383930 BE407839 BE409930 BE408826 AW370292 AA312859 AA136204 AW365852 AW365735 BE622732 AW939295 AA781195 AI017284 AW375329 AW375366 AW178384 AW178333 AW178424 AW365726 AF025440 AW172852 AI570998 AW117792 AI885499 BE465516 BE207427 AW130942 AW513316 AW770892 BE207426 AW173563 AW168292 AW173565 AI810101 AI744983 AI861974 BE207404 AI744982 AI613210 AW591505 AW169285 AI521444 AI745044 AI627904 AI690634 AI289305 AA861253 AI612799 BE207425 AI149694 AA902662 AI082468 AI014752 AA613844 AA725693 AA136089 AI290092 AA565489 AI689083 AI859014 AW051225 AA665758 AA496991 AA564738 T19428 AI567170 AW166726 AW084200 AW188723 AA617626 AI918664 AW381473 AW381543 AA598817 AW088942 AW050423 AI362502 AI680308 AI687500 BE327836 D20455 BE410282 BE254766 BE256014 AA357423 BE618208 AA489577 AW182114 BE379147 |
| 102627 | 25245_1 | AL021918 AA160639 U66561 AA321623 U52098 AL119453 AA455712 N80080 N46550 W07223 N75923 W05057 AI811577 AA455657 AI275409 AI139121 AI927568 AI927562 AI139471 AA160473 N78795 AI719983 AI718928 AA723097 AI335776 N39140 N59184 AI587600 AI864812 AA732097 N74667 AA832398 H89600 D19825 AI554833 |
| 132725 | 29101_1 | NM_006276 NM_006276 L41887 L22253 BE379909 BE567870 BE274265 BE539518 AW239523 AW239271 AI093618 BE504485 BE580279 AA494481 BE440161 AW780428 BE543960 D55986 AA852399 AI630020 W77996 AA278193 R10505 AI963201 AI739336 BE174301 AA662222 AA664912 AA244152 AW611553 BE503285 AA211023 AA383016 AI698174 AW195381 AA948229 AI768495 AI690437 N30025 AI718952 AI953572 BE464509 AA777315 AI337221 AW070910 AI953848 AW674561 H54177 AW510890 AW078699 AI436178 AA630759 BE502074 AA278769 AI499038 AW469072 AA778071 AW236753 AI933033 AI690458 AI276691 AW768235 AI952118 AA425156 AA610579 W73953 AA244153 W86034 AI948872 AI952678 AW087811 AI333591 AI869883 AI926911 W48865 AL048024 AA214485 AI972522 AI151368 W48738 AA214467 AA334640 AI678170 AA927525 AA581588 W96283 AA365470 AI471919 AW611488 AA211834 AI365198 AI698365 AW002238 AA507624 W96150 AA446490 AL048025 AA852400 AA362221 AI338376 R35083 AA290812 R10397 AA975988 AW236462 Z43032 H16969 F13487 D19858 AA452207 BE085942 AA344396 AW949533 AA279472 AW902406 AW070440 BE395195 H00835 AA300750 AA729303 AA420591 AA385025 AA420542 R69155 AA420592 AA281747 N88502 AI458206 AI700996 AW418607 AW341202 AI825692 W00640 AA214405 AA044744 AI950617 BE467493 AW474113 AA446310 BE328705 AI911573 AW243968 AI628622 AW173020 AW079958 AI140387 AW051969 AW299438 AI127170 AW769164 AI422435 AI307116 BE549519 AI371116 AA281748 AA701073 AA679948 BE551197 N50345 AW338776 BE326601 AI142892 AW470687 AI989568 AA911241 AW294822 AI174414 AA804366 AI004725 AW271994 AI559313 AI270102 AI351542 AW768904 AA765964 AI961708 AI149231 AA995907 AI094280 AI185753 H01219 AW768846 AA747500 AA970106 AI601238 AA513452 AW612802 BE075163 R39171 AI565328 AI375559 F10356 AA284625 BE241509 AI702889 AW193010 AA649847 AW439150 AA721407 AA810333 AA706384 AI049887 BE569015 BE622280 BE566618 AW967342 R69269 |
| 111234 | 83711_2 | AA902656 AI185915 R43705 H15150 H09794 AA832464 AI697438 AI354538 AI436354 AA948272 AA928143 AI091263 R41658 AI352580 AI122948 AA946670 AI340088 AI275007 N70255 AA721176 AI934162 AA827098 AA935934 AA827088 AI081207 AA992399 AW130757 AI805667 AA035556 AI379266 AI093901 AI095234 AA909079 AA516079 AI572357 AA205969 AI432383 AA905290 AW628920 AW182996 AI266084 N49879 AW024457 AI246246 AI934031 AI369270 AI003836 AA010063 AA494361 AI284151 AI919536 N34884 N69287 AW510465 AI358609 AW081421 AA706205 AI085317 AI140633 AI347104 AA602547 AI686707 AA872686 AA694028 AI094546 Z40832 AI382838 AA610132 AA501433 H84120 AI140722 AW674839 BE503622 AW663895 BE327472 AW393494 AI340087 W04189 AW393499 H56506 BE089878 BE301950 AI025475 AA724446 BE275324 H15210 AW957667 |
| 134161 | 16074_1 | AA634543 AI682259 AF117108 BE396917 NM_006547 U97188 U76705 BE560799 BE396918 BE269531 BE560268 BE560346 AA836048 AL023775 BE545535 AA427803 C18804 D58801 AA303353 U46218 BE539704 AA187966 AA252545 AA261821 D63197 AI824109 AI088047 AI424833 AI807368 AI250857 AA741476 AI146832 AA169615 AI809821 AI274288 AW136704 AI206172 AA917039 AA243584 AI808611 AW674709 AA935733 AW450092 AA905172 AA471196 AA302256 AW673348 AI352044 AW511295 AA247134 W81035 AA722962 AW662471 R64432 AW044616 AI086619 AW628546 AW043682 AA425750 AI743038 |

TABLE 8B-continued

| Pkey | CAT Number | Accession |
|---|---|---|
| | | AI368723 AA187143 AI376987 AI803976 AI275537 AW471358 |
| | | AW104877 AA195464 W81072 AW197351 AA932674 AI393420 AI434998 |
| | | R63822 AW085083 AI240272 W87006 AA011347 H58428 AI497895 |
| | | R23223 |
| 132939 | 11857_1 | AB009284 AF000416 AA022636 BE082610 AW367997 AA491410 AA337477 AA336421 |
| | | W38526 AA625283 AA773685 AA490078 T66134 |
| | | AA847838 AA022647 AW054726 AI918001 AA431966 AI263596 AI804298 |
| | | AW469314 U76189 AA779001 AA625945 AL042357 AI674730 |
| | | AA410350 AK001450 AV654353 AA058443 D81618 AA853665 W31930 |
| | | AA334445 AW955767 N47777 AA883784 AA428916 AI652062 |
| | | AA329703 AI417923 AI435031 AA708791 AI989636 AI220345 AI239913 |
| | | AI220102 AI435875 AI076731 AI377049 AI039173 AW972638 N90076 |
| | | AW263652 BE440048 BE440013 AA577463 AI038774 AW204992 AA846580 |
| | | AA501952 AA342058 AA508525 D61670 W31725 AI689499 |
| | | AI955969 AA526628 AI282717 T66198 |
| 111345 | 6692_1 | AW263155 AA314512 AW408152 AA360413 BE206274 AK001402 AA307665 AW954678 |
| | | W39078 AW369236 AW369115 AW369096 |
| | | AW753235 AW369072 AW361194 AW369125 AW364187 H94225 T79502 |
| | | AA131908 BE071359 AW368503 AW801517 AW801322 AI674163 |
| | | AA861077 AI738568 AI830199 AW118577 AI478895 AI688497 H92996 |
| | | AW083479 AW970625 AW613124 AI632234 AI654210 AI696847 |
| | | AI923423 AA131909 AA806630 AA806158 AW592520 R96509 AA813923 |
| | | AA502823 AW467889 AA960972 AA994566 AI280346 AA884588 |
| | | AA653563 AI200023 N89820 AW768792 C00145 R96554 T79416 |
| 104301 | 145380_1 | AA768491 AA476251 AA809748 AI186268 AA621244 AI379029 BE550341 |
| | | AA651915 AI216376 AI215585 AI471780 AA772159 AW181980 |
| | | AI151169 AA759270 AI675769 AI018776 AA757335 AA148511 |
| | | AI138378 AA504167 AI420617 AW261930 AW872797 N51769 AW614403 |
| | | AI860533 AW573108 N64830 AI693732 AI436159 BE501089 AI436163 |
| | | AA971485 AI269364 AI935358 AI222050 AW303978 AW573247 |
| | | AI871154 T16758 AI765893 AW969016 AA744720 BE094085 |
| | | AA743769 AI476407 AA156619 AI768535 R81435 D45332 N75682 N51177 |
| | | AW207406 AA425184 R20997 AA504168 Z43298 |
| 134520 | 13358_3 | BE091005 BE541579 AW387738 AW386083 H13769 AW377820 AW369180 |
| | | AW753239 AW672695 BE379572 AW021732 AW891450 |
| | | AW891416 BE091358 N50375 BE091354 BE091365 BE091361 |
| | | BE091363 BE091350 AA353863 AA845510 N21407 AW770981 AI361577 |
| | | AA526557 AA525443 AW893622 AA630898 AI418983 BE172016 |
| | | AA550754 AA664574 C16147 AA355902 AW958586 N51590 C20995 |
| | | BE544186 AI337578 AA090549 AI807374 AW450654 BE067578 |
| | | AA446781 AA447058 T10807 AA457082 AI267703 AI880220 BE568979 |
| | | AW380506 BE150744 AW380468 AW380546 BE150713 D60029 H88099 |
| | | BE546301 BE150731 AW368467 BE091348 |
| 135242 | 5782_1 | AI583187 M73812 AW339829 M74093 BE252510 BE252518 BE536901 U40788 |
| | | W95578 BE018493 BE544205 N83637 AI671049 AW439693 |
| | | AW300786 AW374970 AA592960 AI215885 AI215884 BE302101 |
| | | AI186210 AW771831 T54213 AW452924 AA834019 W95471 AA628312 |
| | | AW304866 AA570076 AI559873 T54121 |
| 134621 | 27351_1 | AA037145 L02547 NM_001324 AW411516 AA314711 AA143605 BE394455 AA325731 |
| | | AA093227 AA083307 BE299438 BE295669 AA370886 |
| | | AA338272 AA166862 BE304837 BE298306 R60507 AW238966 |
| | | N72750 AW505406 AW994153 AA309742 AA309929 BE090721 AW904189 |
| | | AW904214 AA363564 R94127 AA352101 R28249 AA206337 AW577208 |
| | | AA385473 AA355463 AA400696 AA075587 W72815 AA554033 |
| | | AA075530 AA620555 AA554034 T27804 AW950014 AI570740 |
| | | AI268538 AA704423 AW411517 AI278646 AW339924 AI668917 AI796034 |
| | | AA994601 R94082 AW027137 AA400652 AW299746 W72816 AA988494 |
| | | AA146582 AW087489 AA992763 AW516454 AA992759 AW270444 |
| | | AA227188 AI208929 AA167720 AI052527 AA865660 AA569368 |
| | | AI888464 AI670003 AA827620 AA507543 AI888385 R88418 AW959083 |
| | | AI341077 AI825719 BE552285 AA738076 AW085903 R28242 |
| 126802 | 116467_4 | AW805510 AW805503 AW805500 AW805819 AW517040 AW473670 AW516701 T30141 |
| | | AA894497 BE349504 AI272007 AI985274 BE501962 |
| | | AW102975 AI801727 AW197918 T24046 AA947601 AW900958 |
| 126892 | 38252_1 | AF121856 BE242657 U83194 AA226732 AI160190 AA948725 AI079958 AW513369 |
| | | W39443 AW408479 W06854 AA094683 AI985095 |
| | | AA316647 H96313 N78438 R81582 H95034 R79674 AA488552 |
| | | W25292 W31697 W19918 T30640 R08686 H78637 AA165100 Z41909 |
| | | AA165080 R34212 AA150886 T82168 N77082 W56864 R19848 |
| | | AA888217 AA314539 AW750293 N62714 R58039 AA845453 N63268 W03474 |
| | | N41923 AI264123 AI808533 AA824288 AW198143 N99916 AA902465 |
| | | AA775397 AA772387 AI567675 AA227473 AI082614 R58334 N78878 |
| | | R34329 AW438902 AA164685 AA558790 AI590102 AA863422 BE002625 |
| | | AA934039 AI298102 W15351 H93997 AA725325 BE180993 W05350 |
| | | AI510771 W06941 AA488414 R79863 N91264 R76884 AA312948 |
| | | T71267 AW959659 AI086695 N90421 AI278098 AA164538 AI300271 |
| | | AA854381 R81331 AA700449 H06174 AW518427 AA876634 AA150778 |

TABLE 8B-continued

| Pkey | CAT Number | Accession |
|---|---|---|
| | | N32393 H78585 T85364 BE002808 AW663196 N90337 BE252097 |
| | | T71401 H06438 N40268 N31015 R77046 T99588 T85462 W25298 |
| | | T59815 H09416 T85403 W32150 N79109 R78812 |
| 105298 | 8689_1 | BE387790 BE276849 BE246825 BE246900 AA380487 AA332996 AW408727 AK000294 |
| | | AI636887 AW197272 AW590657 AW594006 AI768979 |
| | | AI751632 AA580098 AA313261 AA300475 AA133237 AA233499 |
| | | BE242126 BE242597 BE242254 AA314374 AW961210 AW939345 AA173535 |
| | | AA305779 R99373 AA128304 AA447246 AA476365 T34973 BE264878 |
| | | N25149 Z24939 BE263038 AA128317 Z46082 H23504 AW378551 |
| | | AA088533 AA442625 H15235 H79172 AA344697 AA344742 AL040280 |
| | | BE173256 BE173129 T59749 AA088410 BE242311 AA173576 |
| | | AA455337 AA129715 AA582953 AW612637 AA917038 AW340019 AW006315 |
| | | AW593024 H05915 AW294592 AI146814 AW195659 AW440271 |
| | | AI209090 AI288689 H98630 H15174 AI214454 AI569471 AA085808 |
| | | AW188361 AI751631 AW440477 AW300860 AA516088 AI365108 |
| | | AI305805 AI264064 AI246276 AA442611 AA807059 AA233459 |
| | | AA875987 AI374653 AA972665 AA947515 AA436867 AI216423 AI657181 |
| | | AI680306 AA436854 AI537153 AA883723 Z28659 AA705973 Z40741 |
| | | AA463884 AI216025 AI564986 AA476316 AI432566 AI571662 AA447126 |
| | | AW293675 AI675617 AW009004 H23498 |
| 120438 | 166102_1 | AW015242 AA831493 AI292346 AI076966 AI191561 AA243441 AI183309 AA252613 |
| | | AI038422 AI306531 AW051480 AI348605 AA195119 |
| | | AI817119 AI091896 AA738440 AA195013 AA976687 AA459659 |
| | | AI246250 BE219252 AI703457 AA243291 AA243401 AA989100 AA931640 |
| | | AA459782 |
| 105516 | 9334_1 | AK001269 AL354613 AA147472 AA490803 BE207628 AW816113 AA085574 AW503392 |
| | | AA299910 AW750305 BE079539 BE079484 |
| | | BE512838 AK001593 AW968772 AW967440 AW206280 |
| | | AA251270 AI627886 AA303599 AA147473 BE206616 AA490611 AA715039 |
| | | AW590866 AW590447 AI864512 AA204731 AA894490 BE001136 |
| | | AA612785 AA237035 AA149960 Z44257 R12986 AA448446 AI734041 |
| | | AA422167 BE220551 R66041 R32927 R32942 AA258773 AW386142 |
| | | R53730 N54624 AW880296 AA253485 AW954441 H98989 AW614348 |
| | | AI654838 AA779793 AW237213 N66635 AI186812 AA947479 |
| | | BE158011 AI859480 AW805579 N52010 AA806305 AI628445 AW270990 |
| | | AA778165 AA149949 AI650728 AA749108 AA687257 AI261661 |
| | | AA747442 AA481351 AA206339 AA903407 AW473306 AI688930 AA262281 |
| | | AA448310 AA748820 AI347430 BE465692 R32839 AW510564 AA436408 |
| | | AA257971 AA253362 AA938330 AA513150 AA976840 AA687117 |
| | | AI281547 AA046243 R32825 AI631554 AW139818 AI244536 |
| | | R52946 AW235443 R40183 AA299909 AA811958 AI302918 Z40213 BE158047 |
| | | BE158060 AA767245 AW748159 AW500735 AA094074 |
| 129097 | 25953_1 | BE243933 AA355449 T29766 F08396 N83324 NM_006963 S50223 AI207648 |
| | | AA258092 AA113952 AI311718 AI128612 AW607449 M77172 |
| | | A1951311 X52346 AA903307 AI569810 N55421 W77876 R37223 |
| | | R83788 AA031666 H47092 AA133451 AA311095 AA906963 H87667 N56058 |
| | | AA393593 W24864 H10710 F06925 F07239 AW386140 AA325018 |
| | | AA235950 AW373176 N57158 AA258093 N39467 R21609 BE089979 |
| | | R34173 AW889005 AA745644 AI693852 AA424914 AA744771 W72632 |
| | | AI291213 AA524318 AI472134 AI911230 AA528418 AA115745 |
| | | AA775720 AI671134 AA975044 AW298117 AA321015 N26288 AW952194 |
| | | AI743379 AI204233 AI801026 AA830690 AI146980 AW104611 |
| | | AI338576 R21507 AI367623 BE244484 AI269308 AA031667 |
| | | AI884346 AA731989 AA988943 AA235951 AA807887 AA642645 AI246489 |
| | | N29739 AI216718 AI383349 AI038618 AI351476 AA806031 |
| | | AI914178 H10711 AI095573 H89220 AW470854 AA729015 R83353 AA782239 |
| | | R34295 H87165 AW419059 AI653689 Z40349 H89114 AW074506 |
| | | AA397785 AA888377 AI911228 F03193 AI468783 AA702615 AI830829 |
| | | AA748323 R37224 AA424915 AA731647 H47183 |
| 120619 | 169895_1 | AW965339 AL045632 AA333229 AI806195 AA284372 AA206108 AA682533 AW449514 |
| | | AA804785 AI215473 AI357263 AI651208 A1651753 |
| 129229 | 20927_1 | AF013758 NM_006451 AI538709 AA209236 AA300293 AA367274 |
| | | AA126598 AA324825 AW955225 F11436 AW374740 AW374714 AW374774 |
| | | AW751514 W74780 AI909015 AW997079 AW997067 AW379344 |
| | | AW363397 W38589 AA043823 BE169280 AI909016 AW994851 AI740638 |
| | | AW148560 AW368339 AI858333 AA314718 AW954872 AW468734 AI681980 |
| | | AW519045 AW055171 AA579286 AW069164 AW615004 |
| | | AA345052 AI446735 AI142106 AA662683 AW002813 AI418280 |
| | | AW613203 AI613333 AI354480 AI929755 AI146977 W74674 AW799610 |
| | | AI798529 AI589422 AA043957 AI223043 AA157016 AI446759 D56729 |
| | | AI587471 F30716 AA812125 AI537301 AA653347 D11966 AI434383 |
| | | AA598533 AI287254 AW139140 AW051033 AA601911 AI702506 AA737460 |
| | | T30221 AI129081 N90213 AA805225 AI798518 BE001071 T10841 |
| | | W20199 AW664594 AW195667 D60123 D61496 AW468018 AI720097 |
| | | N90553 AA829375 AW513266 H92758 AA585324 C14767 AI922391 |
| | | D60124 D60666 AW071558 BE044120 AA728821 AA211941 |

TABLE 8B-continued

| Pkey | CAT Number | Accession |
|---|---|---|
| 120821 | 19274_2 | Y19062 NM_014393 AW296801 AK001576 AL079288 W16667 Z45664 AI768561 AL079286 R12736 AW080147 AW136530 AI202958 AW241579 R21013 AA347419 AI929333 AW196689 AI040867 F13437 AA918240 AI869798 AI365176 AW440030 AW440072 N80892 AW242030 Z44807 R12417 AA436784 AA442041 AA046503 AL157526 AI929265 AA055542 AA045462 AA683542 N51374 AW193508 A1873524 AW473151 AW004719 AI810504 AI581093 AA493977 Z40600 F04553 R46130 F09321 |
| 106459 | 3897_1 | AA789081 AW408328 NM_006530 U61384 AA449641 AW138216 AA448598 AJ245746 AI365301 N44728 AA255743 AA360783 BE550380 AW593925 AI962309 AA322097 AW964625 AI695988 AW672827 BE543256 AK001413 AW603395 AA651700 AA449053 AA465540 AW083185 T62128 Z78373 AW673713 AW468061 BE350755 AW673958 AW675504 AA995709 AW574841 AA835883 AI248439 AA548364 T62072 N33193 AA814046 AI376210 AI340020 AA449766 AA703407 AA427613 AI470108 AI298757 AA507602 AI658941 AA449478 AA633165 AA449741 AA831821 AA903673 AA682588 AW673075 |
| 115094 | 190995_1 | AA255920 AI817197 AA255921 AI612925 AW874669 AA493440 |
| 129571 | 1726_1 | X51630 M80232 X61631 S75264 AA172249 AA134066 AA130278 AA130187 AA130291 AA031554 AI246677 Z21455 AI745434 AW273544 AW088613 AW471307 AI745483 AI399854 AI683952 AA031555 AA298075 AI935945 T29809 AA172099 AA356120 |
| 121779 | 287665_1 | AW513143 AA422036 AI821669 AW514232 AA477828 AW772009 AW439799 AW089884 |
| 106738 | 174703_1 | AW149266 R49246 AW237401 AA938113 AW665871 AI969698 AI950812 AW874276 AI571939 AA741222 AI869822 AW104061 AI569994 AW972559 AA506012 AI553704 AA470145 AI332421 AA218990 AW131361 AI709076 AW392488 AW392477 AI970981 AW392476 D61949 H44981 BE172698 |
| 123005 | 75629_1 | AW369771 AW748174 AA290801 AA419198 AA044331 AA127909 AW995442 AI480343 AA044582 AW956159 AA373451 AA127965 AL134913 AW994956 BE622314 BE006298 BE006312 BE006305 BE006317 BE006303 AA043906 AA234175 AA479726 |
| 108055 | 100690_1 | AJ404672 AJ289819 AW976000 AA043561 AW450885 AW452879 AA043562 AA788832 AI564338 AI564330 AI368875 AA643607 AA994375 AA810342 AI367704 |
| 115291 | 22325_1 | BE545072 AI540751 AA301103 AI916675 N85422 BE563965 AA327978 AI816094 AK001515 BE501319 AA279943 BE138895 AA343765 AW963051 AW082308 AI823992 AI653752 AI589007 AI816135 AI566535 BE501307 AW272765 AW242239 AA766315 AI014927 AA578848 AI354483 AI476548 AI038579 AA973322 AA992180 AW472921 BE504789 AI392988 AA506076 AA769228 AI370562 AL137710 BE005656 AW965920 |
| 130376 | 24827__-4 | R40873 |
| 115536 | 61_1 | AK001468 AA190315 AA374980 AW961179 AA307782 AA315295 AA347194 AW953073 AW368190 AW368192 AA280772 AA251247 N85676 AI215522 AI216389 N87835 R12261 R57094 AI660045 AA347193 R16712 AW119006 N55905 N87768 AW900167 AI341261 AI818674 D20285 A1475165 AA300756 R40626 AI122827 AA133250 AI952488 AA970372 AA889845 AW069517 AI524385 AA190314 AI673359 AA971105 AI351088 AI872789 AI919056 AI611216 AK001472 BE568761 AA581004 |
| 114965 | 153955_1 | AI733881 AA165164 AI826437 AI972791 AA165165 BE219575 AI732586 AI821571 AA250737 AW136875 AI984273 AI249271 |
| 131228 | 8262_1 | AW207469 AL079814 AA354351 AF020043 AW291396 BE550484 NM_005445 BE046917 AW594249 AI651554 AI631515 AW771344 AI969758 AI699982 AA247175 AI244676 D44780 AW593978 AI638479 AI373676 AW089547 AL121432 AA554698 AI016991 AI087260 AW449939 AF067163 W40482 AW316558 AI537184 AW381979 W40150 AI810562 AA573151 AI630288 AI675561 AI674420 AW840733 AW022653 AA114219 AJ005015 AL046587 AA878141 AW271896 AW085287 AA150465 BE536295 AA463412 BE093222 AA213739 AA485586 AI825913 AA706307 AI337348 R31995 AI819641 R32095 AW976653 AA742375 AA142957 AI808214 AW468303 AI205987 AI206347 AI769095 BE501640 AA113866 AI093931 AI752855 AA612743 AA463411 AA279157 AI123791 AA213570 AI207305 AW627814 R31945 R32040 |
| 116238 | 10772_1 | AV660717 NM_015437 AL050285 R95774 AI867094 AA443833 AI367670 AA609046 AI440298 AI613139 AI291826 AW028954 AI123242 AI824715 AW079750 AA479362 AW150151 AI952267 AA814094 AI168431 AI566595 AI521422 AI920793 AW051241 N70051 AI689429 A1783813 AI769315 AI743691 AI915645 AA479473 C21435 N50944 N50902 AW978102 H23837 BE087538 AA316516 |

TABLE 8B-continued

| Pkey | CAT Number | Accession |
|---|---|---|
| 122802 | 287993_1 | AI687303 AW571681 AI554465 AI684252 AI581056 AA604098 AI628160 AI859843 AA424021 AA460530 BE042778 AW273200 AW273223 AW167288 AW083347 AI654306 AW517496 AW104706 AW273214 BE139512 AW189487 AW130822 AW167419 AI289485 AW150010 H88004 AI743745 AW088710 |
| 123494 | 21202_1 | AW179019 AW179011 AF135I60 NM_014050 AF078860 BE018005 AK000285 AF151038 BE245156 AW179007 AA345114 BE619758 BE619209 W25509 AA314339 AA336674 AA337956 AW954843 AW390412 N46796 AA316235 AA314286 R15686 BE535633 N57134 N46483 AW368462 AA923517 AA665223 AI418513 AA837523 AI359320 AI309273 AI522278 N40939 AA904977 AA938272 N30240 AA887965 AI671972 AI028109 AA094652 AA883262 AA887781 AI744447 AW592944 AI077790 AW860883 AW148667 N89861 AA557195 AI191824 AI433166 AI719760 AA453089 AA630656 AA300976 AI309620 AW675033 AA284393 AW886987 AI476335 AI332939 BE301513 AA452920 AW674302 AI925483 AW170412 AI698717 AI375985 BE220535 AI688151 AW514809 AW062346 AA599786 BE350848 AI560848 AI023075 AA864875 AA166871 AI807947 AW514579 AI978602 AI860340 AA830886 AI374788 AI283592 AA683152 AA743159 AI379932 AI432056 AI128904 AW150433 N38909 |
| 116296 | 11967_2 | AW149502 Z43342 AW002826 AL049382 AA442545 AW971471 BE220243 AW968952 AA043607 AW299245 AA659892 AI038768 H26330 BE463534 AI628252 AA836139 AI277291 AA489033 AA741239 AI209064 AI300253 AI275761 Z39417 C01835 |

Pkey Unique Eos probeset identifier number
CAT number Gene cluster number
Accession Genbank accession numbers Table 9A lists about 382 genes up-regulated in ovarian cancer compared to normal ovaries These were selected from 35403 probesets on the Affymetrix/Eos-Hu01 Gene-Chip array such that the ratio of "average" ovarian cancer to "average" normal adult ovaries was greater than or equal to 10 The "average" ovarian cancer level was set to the 2nd highest amongst various ovarian cancers. The "average" normal adult ovaries level was set to the arithmetic mean amongst various non-malignant ovaries In order to remove gene-specific background levels of non-specific hybridization, the 15th percentile value amongst the non-malignant tissues (see Table 7A) was subtracted from both the numerator and the denominator before the ratio was evaluated

TABLE 9A

382 UP-REGULATED GENES, OVARIAN CANCER VERSUS NORMAL OVARY

| Pkey | Ex Accn | UG ID | Title | ratio |
|---|---|---|---|---|
| 134454 | L33930 | Hs. 173996 | CD24 antigen (small cell lung carcinoma clust | 86.2 |
| 102927 | X12876 | Hs.65114 | keratin 18 | 84.7 |
| 115909 | AA436666 | Hs. 59761 | ESTs | 72.3 |
| 123169 | AA488892 | Hs. 104472 | ESTs, Weakly similar to Gag-Pol polyprotein [ | 66.8 |
| 115674 | AA406542 | Hs. 71520 | ESTs | 65.4 |
| 102193 | U20758 | Hs.313 | secreted phosphoprotein 1 (osteopontin, bone | 63.1 |
| 101839 | M93036 | Hs. 692 | membrane component; chromosomal 4, surface ma | 56.8 |
| 115221 | AA262942 | Hs. 79741 | ESTs | 56.1 |
| 108059 | AA043944 | Hs. 62663 | ESTs | 52.3 |
| 121853 | AA425887 | Hs.98502 | ESTs | 47.8 |
| 133504 | W95070 | Hs. 74316 | desmoplakin (DPI, DPII) | 47.0 |
| 103546 | Z14244 | Hs. 75752 | cytochrome c oxidase subunit VIIb | 46.5 |
| 100147 | D13666 | Hs. 136348 | osteoblast specific factor 2 (fasciclin I-lik | 45.5 |
| 102979 | X17042 | Hs.1908 | proteoglycan 1; secretory granule | 44.6 |
| 130967 | AA134138 | Hs.182579 | *Homo sapiens* leucine aminopeptidase mRNA, com | 44.5 |
| 102009 | U02680 | Hs. 82643 | protein tyrosine kinase 9 | 40.4 |
| 126960 | AA317900 | Hs. 161756 | ESTs | 39.6 |
| 103111 | X63187 | Hs. 2719 | epididymis-specific, whey-acidic protein type | 39.1 |
| 133829 | AA453783 | Hs. 76550 | *Homo sapiens* mRNA, cDNA DKFZp564B1264 (from c | 39.0 |
| 111223 | N68921 | Hs. 34806 | ESTs, Weakly similar to neogenin [*H. sapiens*] | 38.9 |
| 102803 | U89916 | Hs.26126 | claudin 10 | 38.8 |
| 104943 | AA065217 | Hs. 169674 | ESTs | 38.7 |
| 106605 | AA457718 | Hs. 21103 | *Homo sapiens* mRNA, cDNA DKFZp564B076 (from cl | 38.4 |
| 120655 | AA287347 | Hs. 238205 | ESTs | 38.1 |
| 102968 | X16396 | Hs.154672 | methylene tetrahydrofolate dehydrogenase (NAD | 36.3 |
| 104052 | AA393164 | Hs.97644 | mammaglobin 2 | 36.0 |
| 109166 | AA179845 | Hs. 73625 | RAB6 interacting, kinesin-like (rabkinesin6) | 35.9 |
| 101332 | L47276 | | *Homo sapiens* (cell line HL-6) alpha topoisome | 35.0 |
| 106167 | AA425906 | Hs. 7956 | ESTs | 34.5 |
| 101042 | J05428 | Hs.10319 | UDP glycosyltransferase 2 family, polypeptide | 34.3 |

TABLE 9A-continued

382 UP-REGULATED GENES, OVARIAN CANCER VERSUS NORMAL OVARY

| Pkey | Ex Accn | UG ID | Title | ratio |
|---|---|---|---|---|
| 125852 | H09290 | Hs. 76550 | *Homo sapiens* mRNA; cDNA DKFZp564B1264 (from c | 33.7 |
| 101201 | L22524 | Hs. 2256 | matrix metalloproteinase 7 (matrilysin, uten | 32.3 |
| 126410 | R51912 | Hs. 12409 | somatostatin | 32.1 |
| 134326 | U16306 | Hs. 81800 | chondroitin sulfate proteoglycan 2 (versican) | 32.0 |
| 125739 | AA428557 | Hs. 92137 | v-myc avian myelocytomatosis viral oncogene h | 31.6 |
| 132254 | L20826 | Hs.430 | plastin 1 (I isoform) | 31.4 |
| 112610 | R79392 | Hs. 23643 | ESTs | 30.9 |
| 101441 | M21005 | Hs. 100000 | S100 calcium-binding protein A8 (calgranulin | 30.6 |
| 116345 | AA496981 | Hs. 199067 | HER3 receptor tyrosine kinase (c-erbB3; ERBB3 | 30.1 |
| 108860 | AA133334 | Hs.129911 | ESTs | 29.8 |
| 133859 | U86782 | Hs. 178761 | 26S proteasome-associated pad1 homolog | 29.2 |
| 107295 | T34527 | Hs. 80120 | UDP-N-acetyl-alpha-D-galactosamine polypeptid | 28.9 |
| 106210 | AA428239 | Hs. 10338 | ESTs | 28.9 |
| 134711 | X04011 | Hs.88974 | cytochrome b-245; beta polypeptide (chronic g | 28.0 |
| 125769 | AI382972 | Hs. 82128 | 5T4 oncofetal trophoblast glycoprotein | 27.5 |
| 107222 | D51235 | Hs. 82689 | tumor rejection antigen (gp96) 1 | 27.4 |
| 102260 | U28386 | Hs. 159557 | karyopherin alpha 2 (RAG cohort 1, importin a | 26.9 |
| 134691 | M59979 | Hs.88474 | prostaglandin-endoperoxide synthase 1 (prosta | 26.8 |
| 105588 | AA279215 | Hs. 10867 | ESTs | 26.3 |
| 130718 | N70196 | Hs. 18376 | ESTs | 26.3 |
| 111185 | N67551 | Hs. 12844 | EGF-like-domain, multiple 6 | 25.6 |
| 131965 | W90146 | Hs. 35962 | ESTs | 25.6 |
| 132903 | AA235404 | Hs. 5985 | *Homo sapiens* clone 25186 mRNA sequence | 25.6 |
| 114359 | Z41589 | Hs.153483 | ESTs, Moderately similar to H1 chloride chann | 25.5 |
| 101185 | L19872 | Hs. 170087 | aryl hydrocarbon receptor | 25.2 |
| 128742 | D00763 | Hs. 251531 | proteasome (prosome, macropain) subunit, alph | 25.1 |
| 116724 | F13665 | Hs. 65641 | ESTs | 24.9 |
| 111929 | R40057 | Hs. 112360 | prominin (mouse)-like 1 | 24.9 |
| 102915 | X07820 | Hs.2258 | matrix metalloproteinase 10 (stromelysin 2) | 24.8 |
| 131210 | AA430047 | Hs. 24248 | ESTs | 24.7 |
| 101714 | M68874 | | Human phosphatidylcholine 2-acylhydrolase (cP | 24.6 |
| 100154 | D14657 | Hs. 81892 | KIAA0101 gene product | 24.6 |
| 134656 | X14787 | Hs. 87409 | thrombospondin 1 | 24.3 |
| 100294 | D49396 | Hs.75454 | antioxidant protein 1 | 23.9 |
| 104080 | AA402971 | Hs. 57771 | kallikrein 11 | 23.7 |
| 107056 | AA600310 | Hs. 18720 | programmed cell death 8 (apoptosis-inducing f | 23.7 |
| 115697 | AA411502 | Hs. 63325 | ESTs, Weakly similar to airway trypsin-like p | 23.7 |
| 130350 | U02020 | Hs. 239138 | pre-B-cell colony-enhancing factor | 23.7 |
| 105870 | AA399623 | Hs. 23505 | ESTs | 23.6 |
| 118528 | N67889 | Hs.49397 | ESTs | 23.4 |
| 105309 | AA233790 | Hs. 4104 | ESTs, Weakly similar to cDNA EST yk386g7.5 co | 23.2 |
| 109680 | F09255 | Hs. 4993 | ESTs | 23.2 |
| 131501 | AA121127 | Hs. 181307 | H3 histone, family 3A | 23.2 |
| 100824 | HG4058-HT4328 | | Oncogene Aml1-Evi-1, Fusion Activated | 23.1 |
| 111890 | R38678 | Hs.12365 | ESTs | 23.0 |
| 101543 | M31166 | Hs. 2050 | pentaxin-related gene, rapidly induced by IL- | 22.8 |
| 102095 | U11313 | Hs. 75760 | sterol carrier protein 2 | 22.8 |
| 114988 | AA251089 | Hs. 94576 | ESTs, Weakly similar to phosducin, retinal [H | 22.8 |
| 120695 | AA291468 | | ESTs | 22.8 |
| 130941 | D49394 | Hs. 2142 | 5-hydroxytryptamine (serotonin) receptor 3A | 22.8 |
| 106654 | AA460449 | Hs. 3784 | ESTs, Highly similar to phosphoserine aminotr | 22.7 |
| 109141 | AA176428 | Hs. 193380 | ESTs | 22.6 |
| 102345 | U37283 | Hs. 58882 | Microfibril-associated glycoprotein-2 | 22.6 |
| 115652 | AA405098 | Hs. 38178 | ESTs | 22.4 |
| 100103 | AF007875 | Hs.5085 | dolichyl-phosphate mannosyltransferase polype | 22.3 |
| 105463 | AA253370 | Hs. 32646 | ESTs | 22.2 |
| 132624 | AA164819 | Hs. 53631 | ESTs | 22.2 |
| 119743 | W70242 | Hs. 58086 | ESTs | 22.0 |
| 132528 | AA283006 | Hs. 50758 | chromosome-associated polypeptide C | 22.0 |
| 107174 | AA621714 | Hs. 25338 | ESTs | 21.8 |
| 134495 | D63477 | Hs.84087 | KIAA0143 protein | 21.8 |
| 131985 | AA434329 | Hs. 36563 | ESTs | 21.5 |
| 105832 | AA398346 | Hs. 21898 | ESTs | 21.2 |
| 126160 | N90960 | Hs. 247277 | ESTs, Weakly similar to transformation-relate | 21.2 |
| 114846 | AA234929 | Hs. 44343 | ESTs | 20.9 |
| 109703 | F09684 | Hs. 24792 | ESTs; Weakly similar to ORF YOR283w [S.cerevi | 20.9 |
| 135154 | AA126433 | Hs.173242 | sorting nexin 4 | 20.8 |
| 131185 | M25753 | Hs. 23960 | cyclin B1 | 20.7 |
| 105616 | AA280670 | Hs. 24968 | ESTs | 20.5 |
| 131148 | C00038 | Hs.23579 | ESTs | 20.2 |
| 129337 | R63542 | Hs. 110488 | KIAA0990 protein | 20.2 |
| 133640 | D83004 | Hs. 75355 | ubiquitin-conjugating enzyme E2N (homologous | 20.1 |
| 127479 | AA513722 | Hs. 179729 | collagen, type X, alpha 1 (Schmid metaphyseal | 19.9 |
| 133711 | J04130 | Hs. 75703 | small inducible cytokine A4 (homologous to mo | 19.8 |
| 131818 | Z39297 | Hs.3281 | neuronal pentraxin II | 19.7 |

TABLE 9A-continued

382 UP-REGULATED GENES, OVARIAN CANCER VERSUS NORMAL OVARY

| Pkey | Ex Accn | UG ID | Title | ratio |
|---|---|---|---|---|
| 125303 | Z39821 | Hs. 107295 | ESTs | 19.6 |
| 109112 | AA169379 | Hs. 72865 | ESTs | 19.5 |
| 105376 | AA236559 | Hs. 8768 | ESTs; Weakly similar to !!!! ALU SUBFAMILY SQ | 19.2 |
| 103605 | Z35402 | Hs. 194657 | cadherin 1, E-cadherin (epithelial) | 19.1 |
| 100661 | HG2874-HT3018 | | Ribosomal Protein L39 Homolog | 19.1 |
| 129571 | X51630 | Hs.1145 | Wilms tumor 1 | 19.0 |
| 115239 | AA278650 | Hs. 73291 | ESTs, Weakly similar to similar to the beta t | 18.9 |
| 131562 | U90551 | Hs. 28777 | H2A histone family, member L | 18.9 |
| 131272 | AA423884 | Hs. 139033 | paternally expressed gene 3 | 18.9 |
| 130343 | AA490262 | Hs.15485 | ESTs, Weakly similar to APICAL-LIKE PROTEIN [ | 18.8 |
| 103245 | X76648 | Hs. 28988 | glutaredoxin (thioltransferase) | 18.7 |
| 101809 | M86849 | | Homo sapiens connexin 26 (GJB2) mRNA, complet | 18.6 |
| 105344 | AA235303 | Hs. 8645 | ESTs | 18.4 |
| 135225 | AA455988 | Hs. 9667 | butyrobetaine (gamma); 2-oxoglutarate dioxyge | 18.4 |
| 116786 | H25836 | Hs.83429 | tumor necrosis factor (ligand) superfamily; m | 18.3 |
| 131510 | AA207114 | Hs.27842 | ESTs, Weakly similar to similar to 1-acyl-gly | 18.2 |
| 124059 | F13673 | Hs. 99769 | ESTs | 18.0 |
| 103352 | X89398 | Hs.78853 | uracil-DNA glycosylase | 17.9 |
| 132742 | AA490862 | Hs. 55901 | ESTs, Weakly similar to C43H8 1 [C elegans] | 17.9 |
| 135242 | M74093 | Hs. 9700 | cyclin E1 | 17.9 |
| 123494 | AA599786 | Hs. 112110 | ESTs | 17.8 |
| 129168 | T90621 | Hs.109052 | chromosome 14 open reading frame 2 | 17.7 |
| 128517 | AA280617 | Hs. 100861 | ESTs; Weakly similar to p60 katanin [H sapien | 17.6 |
| 130160 | Z39228 | Hs. 151344 | UDP-Gal.betaGlcNAc beta 1,3-galactosyltransfe | 17.6 |
| 103448 | X99133 | Hs. 204238 | lipocalin 2 (oncogene 24p3) | 17.5 |
| 119708 | W67810 | Hs. 57904 | mago-nashi (Drosophila) homolog, proliferatio | 17.5 |
| 122946 | AA477445 | Hs. 105341 | ESTs | 17.5 |
| 125819 | AA044840 | Hs. 251871 | CTP synthase | 17.5 |
| 131689 | AA599653 | Hs.30696 | transcription factor-likes 5 (basic helix-loop | 17.5 |
| 115061 | AA253217 | Hs. 41271 | ESTs | 17.3 |
| 113702 | T97307 | Hs. 161720 | ESTs; Moderately similar to !!!! ALU SUBFAMIL | 17.3 |
| 115291 | AA279943 | Hs. 122579 | ESTs | 17.3 |
| 102567 | U59863 | Hs. 146847 | TRAF family member-associated NFKB activator | 17.2 |
| 129229 | AA211941 | Hs. 109643 | polyadenylate binding protein-interacting pro | 17.2 |
| 129351 | AA167268 | Hs. 62349 | Human ras inhibitor mRNA, 3' end | 17.2 |
| 110769 | N22222 | | yw34b06 s1 Morton Fetal Cochlea Homo sapiens | 17.1 |
| 113182 | T55234 | Hs. 9676 | Human DNA sequence from clone 30M3 on chromos | 17.0 |
| 115892 | AA435946 | Hs. 50831 | ESTs | 17.0 |
| 123114 | AA486407 | Hs. 105235 | ESTs, Moderately similar to KIAA0454 protein | 17.0 |
| 123442 | AA598803 | Hs. 111496 | ESTs | 17.0 |
| 123339 | AA504253 | Hs.101515 | ESTs | 16.9 |
| 123689 | AA609556 | Hs. 256562 | ESTs | 16.9 |
| 131941 | D62657 | Hs. 35086 | ubiquitin-specific protease 1 | 16.8 |
| 120649 | AA287115 | Hs.99697 | ESTs | 16.8 |
| 102139 | U15932 | Hs. 2128 | dual specificity phosphatase 5 | 16.8 |
| 115522 | AA331393 | Hs. 47378 | ESTs | 16.7 |
| 135243 | AA215333 | Hs. 97101 | putative G protein-coupled receptor | 16.6 |
| 131257 | AA256042 | Hs.24908 | ESTs | 16.5 |
| 109508 | AA233892 | Hs. 55902 | ESTs, Weakly similar to !!!! ALU SUBFAMILY SX | 16.3 |
| 132701 | AA279359 | Hs. 55220 | BCL2-associated athanogene 2 | 16.3 |
| 134449 | L34155 | Hs.83450 | laminin, alpha 3 (nicein (150kD); kalinin (16 | 16.3 |
| 126180 | R18070 | Hs. 3712 | ubiquinol-cytochrome c reductase, Rieske iron | 16.3 |
| 106124 | AA423987 | Hs. 7567 | ESTs | 16.2 |
| 115363 | AA282071 | Hs. 152759 | activator of S phase kinase | 16.2 |
| 117588 | N34895 | Hs.44648 | ESTs | 16.1 |
| 131245 | AA620599 | Hs. 24766 | DKFZP564E1962 protein | 16.1 |
| 101674 | M61916 | Hs. 82124 | laminin, beta 1 | 16.0 |
| 126819 | AA305536 | Hs. 161489 | ESTs | 16.0 |
| 134039 | S78569 | Hs.78672 | laminin; alpha 4 | 16.0 |
| 130648 | AA075427 | Hs.17296 | ESTs, Weakly similar to /prediction | 15.9 |
| 102823 | U90914 | Hs. 5057 | carboxypeptidase D | 15.8 |
| 128470 | AA447504 | Hs. 100261 | Homo sapiens mRNA, cDNA DKFZp564B222 (from cl | 15.8 |
| 115844 | AA430124 | Hs. 234607 | ESTs | 15.7 |
| 132543 | AA417152 | Hs.5101 | protein regulator of cytokinesis 1 | 15.7 |
| 130155 | L33404 | Hs. 151254 | kallikrein 7 (chymotryptic; stratum corneum) | 15.7 |
| 101008 | J04162 | Hs. 763 | Fc fragment of IgG, low affinity IIIa, recept | 15.7 |
| 120472 | AA251875 | Hs. 104472 | ESTs; Weakly similar to Gag-Pol polyprotein [ | 15.6 |
| 116844 | H64938 | Hs.38331 | ESTs | 15.6 |
| 106753 | AA476944 | Hs. 7331 | ESTs | 15.6 |
| 114767 | AA148885 | Hs. 154443 | minichromosome maintenance deficient (S cere | 15.5 |
| 114768 | AA149007 | Hs. 182339 | Ets homologous factor | 15.5 |
| 127370 | AI024352 | Hs.70337 | immunoglobulin superfamily, member 4 | 15.5 |
| 101507 | M27492 | Hs. 82112 | interleukin 1 receptor, type I | 15.4 |
| 102519 | U52969 | Hs. 80296 | Purkinje cell protein 4 | 15.4 |
| 102610 | U65011 | Hs.30743 | preferentially expressed antigen in melanoma | 15.4 |

TABLE 9A-continued

382 UP-REGULATED GENES, OVARIAN CANCER VERSUS NORMAL OVARY

| Pkey | Ex Accn | UG ID | Title | ratio |
|---|---|---|---|---|
| 111244 | N69556 | Hs.24724 | MFH-amplified sequences with leucine-rich tan | 15.4 |
| 120404 | AA234921 | Hs. 96427 | KIAA1013 protein | 15.3 |
| 130455 | X17059 | Hs. 155956 | N-acetyltransferase 1 (arylamine N-acetyltran | 15.2 |
| 129519 | AA298786 | Hs. 112242 | ESTs | 15.1 |
| 106553 | AA454967 | Hs. 5887 | ESTs; Highly similar to RNA binding motif pro | 15.0 |
| 109502 | AA233837 | Hs.44755 | ESTs; Weakly similar to membrane glycoprotein | 14.9 |
| 115967 | AA446887 | Hs. 42911 | ESTs | 14.9 |
| 104636 | AA004415 | Hs.106106 | ESTs | 14.9 |
| 134133 | X93920 | Hs.180383 | dual specificity phosphatase 6 | 14.9 |
| 134444 | X04470 | Hs.251754 | secretory leukocyte protease inhibitor (antil | 14.8 |
| 132998 | Y00062 | Hs. 170121 | protein tyrosine phosphatase, receptor type, | 14.8 |
| 131997 | D82399 | Hs. 136644 | Homo sapiens clone 23714 mRNA sequence | 14.6 |
| 134056 | R27358 | Hs. 7886 | ESTs; Weakly similar to Pelle associated prot | 14.6 |
| 101249 | L33881 | Hs.1904 | protein kinase C; iota | 14.5 |
| 105298 | AA233459 | Hs.26369 | ESTs | 14.5 |
| 107119 | AA620307 | Hs. 27379 | ESTs | 14.5 |
| 115839 | AA429038 | Hs. 40541 | ESTs | 14.5 |
| 122802 | AA460530 | Hs. 256579 | ESTs | 14.5 |
| 129896 | AA043021 | Hs. 13225 | UDP-Gal: betaGlcNAc beta 1; 4-galactosyltransf | 14.3 |
| 130269 | AA284694 | Hs.168352 | nucleoporin-like protein 1 | 14.3 |
| 134374 | D62633 | Hs. 8236 | ESTs | 14.3 |
| 106370 | AA443841 | Hs. 18676 | sprouty (Drosophila) homolog 2 | 14.2 |
| 130919 | AA291710 | Hs. 21276 | collagen: type IV, alpha 3 (Goodpasture antig | 14.1 |
| 132923 | U21858 | Hs. 60679 | TATA box binding protein (TBP)-associated fac | 14.1 |
| 107968 | AA034020 | Hs. 61539 | ESTs | 14.1 |
| 125390 | H95094 | Hs. 75187 | translocase of outer mitochondrial membrane 2 | 14.1 |
| 107148 | AA621131 | Hs. 5889 | ESTs; Weakly similar to W01A11.2 gene product | 14.1 |
| 110788 | N24730 | Hs.15420 | ESTs | 14.0 |
| 109481 | AA233342 | Hs. 90680 | ESTs, Weakly similar to WD40 protein Ciao 1 [ | 13.9 |
| 105646 | AA282147 | Hs. 5888 | ESTs | 13.9 |
| 106030 | AA412251 | Hs. 12802 | development and differentiation enhancing fac | 13.8 |
| 132618 | AA253330 | Hs. 5344 | adaptor-related protein complex 1; gamma 1 su | 13.7 |
| 133230 | S82240 | Hs. 6838 | ras homolog gene family, member E | 13.7 |
| 124803 | R45480 | Hs. 164866 | cyclin K | 13.6 |
| 121381 | AA405747 | Hs.97865 | ESTs, Weakly similar to WASP-family protein [ | 13.6 |
| 105200 | AA195399 | Hs.24641 | ESTs | 13.5 |
| 105627 | AA281245 | Hs. 23317 | ESTs | 13.5 |
| 114986 | AA251010 | Hs. 87807 | ESTs | 13.5 |
| 118036 | N52844 | Hs. 196008 | ESTs | 13.5 |
| 134672 | N79749 | Hs. 87627 | ESTs; Weakly similar to cDNA EST EMBL: T00542 | 13.5 |
| 110915 | N46252 | Hs. 29724 | ESTs | 13.3 |
| 117984 | N51919 | Hs. 47368 | ESTs | 13.3 |
| 132550 | AA029597 | Hs. 170195 | bone morphogenetic protein 7 (osteogenic prot | 13.3 |
| 124315 | H94892 | Hs.6906 | v-ral simian leukemia viral oncogene homolog | 13.2 |
| 102547 | U57911 | Hs. 46638 | chromosome 11 open reading frame 8 | 13.2 |
| 125134 | W19228 | Hs. 100748 | ESTs | 13.2 |
| 111806 | R33468 | Hs. 24651 | ESTs | 13.1 |
| 106983 | AA521195 | Hs.10887 | similar to lysosome-associated membrane glyco | 13.0 |
| 106498 | AA452141 | Hs. 7171 | ESTs | 13.0 |
| 110787 | N24716 | Hs. 12244 | ESTs, Weakly similar to C44B9.1 [C. elegans] | 13.0 |
| 122860 | AA464414 | Hs. 112159 | ESTs | 13.0 |
| 131535 | AA504642 | Hs. 28436 | ESTs, Weakly similar to coded for by C. elega | 13.0 |
| 116188 | AA464728 | Hs. 184598 | ESTs | 13.0 |
| 107243 | D59489 | Hs. 34727 | ESTs | 12.9 |
| 129300 | C20976 | Hs.110165 | ESTs, Highly similar to ribosomal protein L26 | 12.9 |
| 134487 | R38185 | Hs. 83954 | Homo sapiens unknown mRNA | 12.8 |
| 102348 | U37519 | Hs. 87539 | aldehyde dehydrogenase 8 | 12.8 |
| 131839 | H80622 | Hs. 33010 | KIAA0633 protein | 12.8 |
| 119620 | W47620 | Hs. 56009 | 2'-5' oligoadenylate synthetase 3 | 12.8 |
| 120802 | AA343533 | Hs. 128777 | ESTs; Weakly similar to predicted using Genef | 12.7 |
| 102250 | U28014 | Hs. 74122 | caspase 4, apoptosis-related cysteine proteas | 12.7 |
| 105539 | AA258873 | Hs. 25242 | ESTs | 12.7 |
| 114965 | AA250737 | Hs.72472 | ESTs | 12.7 |
| 118001 | N52151 | Hs. 47447 | ESTs | 12.7 |
| 100448 | D87469 | Hs. 57652 | EGF-like-domain, multiple 2 | 12.6 |
| 130920 | D50975 | Hs. 75525 | calreticulin | 12.6 |
| 131075 | Y00757 | Hs. 2265 | secretory granule; neuroendocrine protein 1 ( | 12.6 |
| 105496 | AA256323 | Hs. 25264 | DKFZP434N126 protein | 12.5 |
| 109235 | AA193592 | Hs. 42300 | ESTs; Weakly similar to !!!! ALU SUBFAMILY SQ | 12.5 |
| 118215 | N62195 | Hs.77910 | 3-hydroxy-3-methylglutaryl-Coenzyme A synthas | 12.5 |
| 134388 | M15841 | Hs. 82575 | small nuclear ribonucleoprotein polypeptide B | 12.5 |
| 106897 | AA489790 | Hs. 167496 | RAN binding protein 6 | 12.4 |
| 133050 | S67325 | Hs. 63788 | propionyl Coenzyme A carboxylase, beta polype | 12.4 |
| 109683 | F09308 | Hs. 27607 | ESTs | 12.3 |
| 121463 | AA411745 | Hs.239681 | ESTs, Weakly similar to KIAA0554 protein [H.s | 12.3 |

TABLE 9A-continued

382 UP-REGULATED GENES, OVARIAN CANCER VERSUS NORMAL OVARY

| Pkey | Ex Accn | UG ID | Title | ratio |
|---|---|---|---|---|
| 102876 | X03663 | Hs. 174142 | colony stimulating factor 1 receptor, formerl | 12.2 |
| 101804 | M86699 | Hs. 169840 | TTK protein kinase | 12.2 |
| 129017 | H13108 | Hs. 107968 | ESTs | 12.1 |
| 105812 | AA394126 | Hs. 20814 | ESTs; Highly similar to CGI-27 protein [H.sap | 12.1 |
| 106459 | AA449741 | Hs.4029 | glioma-amplified sequence-41 | 12.0 |
| 107059 | AA608545 | Hs. 23044 | RAD51 (S cerevisiae) homolog (E coli RecA ho | 12.0 |
| 107080 | AA609210 | Hs. 19221 | ESTs | 12.0 |
| 110799 | N26101 | Hs. 7838 | Human ring zinc-finger protein (ZNF127-Xp) ge | 12.0 |
| 112253 | R51818 | Hs.104222 | Homo sapiens mRNA, cDNA DKFZp566L034 (from cl | 12.0 |
| 116760 | H11054 | Hs.155342 | protein kinase C; delta | 12.0 |
| 120314 | AA194166 | Hs. 221040 | KIAA1038 protein | 12.0 |
| 123005 | AA479726 | Hs. 105577 | ESTs | 12.0 |
| 132572 | AA448297 | Hs. 237825 | signal recognition particle 72 kD | 12.0 |
| 110561 | H59617 | Hs. 5199 | ESTs; Weakly similar to UBIQUITIN-CONJUGATING | 12.0 |
| 101923 | S75256 | | HNL = neutrophil lipocalin [human, ovarian canc | 11.9 |
| 134992 | H05625 | Hs.92414 | ESTs | 11.8 |
| 105516 | AA257971 | Hs.21214 | ESTs | 11.8 |
| 105248 | AA226968 | Hs. 22826 | ESTs | 11.7 |
| 109130 | AA172040 | Hs. 20161 | ESTs, Weakly similar to IgE receptor beta sub | 11.7 |
| 115955 | AA446121 | Hs. 44198 | Homo sapiens BAC clone RG054D04 from 7q31 | 11.7 |
| 116135 | AA460314 | Hs. 94179 | ESTs | 11.7 |
| 116284 | AA487252 | Hs. 237809 | ESTs, Weakly similar to hypothetical protein | 11.7 |
| 132384 | AA479933 | Hs. 46967 | Human DNA sequence from clone 167A19 on chrom | 11.7 |
| 134753 | Y09216 | Hs. 173135 | dual-specificity tyrosine-(Y)-phosphorylation | 11.7 |
| 125136 | W31479 | Hs.129051 | ESTs | 11.7 |
| 133928 | N34096 | Hs. 7766 | ubiquitin-conjugating enzyme E2E 1 (homologou | 11.6 |
| 117395 | N26330 | Hs. 93701 | ESTs | 11.5 |
| 127007 | AA299360 | | EST11857 Uterus tumor I Homo sapiens cDNA 5' | 11.5 |
| 130567 | L07493 | Hs. 1608 | replication protein A3 (14 kD) | 11.5 |
| 135073 | AA452000 | Hs.94030 | Homo sapiens mRNA, cDNA DKFZp586E1624 (from c | 11.5 |
| 115140 | AA258030 | Hs. 55356 | ESTs, Weakly similar to supported by GENSCAN | 11.4 |
| 115536 | 11347193 | Hs. 62180 | ESTs | 11.4 |
| 133240 | D31161 | Hs. 68613 | ESTs | 11.3 |
| 106521 | AA453431 | Hs. 14732 | malic enzyme 1, NADP(+)-dependent cytosolic | 11.3 |
| 107674 | AA011027 | Hs.41143 | KIAA0581 protein | 11.3 |
| 114149 | Z38814 | Hs. 27196 | ESTs | 11.3 |
| 132478 | H20906 | Hs. 49500 | KIAA0746 protein | 11.2 |
| 104252 | AF002246 | Hs. 210863 | cell adhesion molecule with homology to L1CAM | 11.2 |
| 102436 | U46499 | Hs.790 | microsomal glutathione S-transferase 1 | 11.2 |
| 106726 | AA465339 | Hs. 7141 | ESTs | 11.2 |
| 100116 | D00654 | Hs. 77443 | actin, gamma 2, smooth muscle, enteric | 11.2 |
| 110970 | N51374 | Hs. 96870 | Homo sapiens mRNA full length insert cDNA clo | 11.2 |
| 130417 | U58522 | Hs.155485 | huntingtin-interacting protein 2 | 11.2 |
| 132906 | AA142857 | Hs.234896 | ESTs, Highly similar to geminin [H. sapiens] | 11.2 |
| 107853 | AA024427 | Hs. 59461 | DKFZP434C245 protein | 11.2 |
| 103467 | Y00451 | Hs. 78712 | aminolevulinate; delta-; synthase 1 | 11.1 |
| 100438 | D87448 | Hs. 91417 | topoisomerase (DNA) II binding protein | 11.1 |
| 102654 | U68494 | Hs. 24385 | Human hbc647 mRNA sequence | 11.1 |
| 103172 | X68742 | Hs. 116774 | integrin; alpha 1 | 11.1 |
| 106856 | AA486183 | Hs.15839 | ESTs, Weakly similar to similar to oxysterol- | 11.1 |
| 108255 | AA063157 | Hs.172608 | ESTs | 11.1 |
| 124308 | H93575 | Hs.227146 | Homo sapiens mRNA, cDNA DKFZp564J142 (from cl | 11.1 |
| 129057 | X62466 | Hs. 214742 | CDW52 antigen (CAMPATH-1 antigen) | 11.1 |
| 128845 | AA455658 | Hs. 10649 | basement membrane-induced gene | 11.1 |
| 129025 | AA420992 | Hs.103441 | ESTs; Weakly similar to testicular tektin B1- | 11.0 |
| 107638 | AA009528 | Hs. 42743 | ESTs; Weakly similar to predicted using Genef | 11.0 |
| 134480 | AA024664 | Hs. 83916 | NADH dehydrogenase (ubiquinone) 1 alpha subco | 11.0 |
| 115262 | AA279112 | Hs. 88594 | ESTs | 11.0 |
| 102580 | U60808 | Hs.152981 | CDP-diacylglycerol synthase (phosphatidate cy | 10.9 |
| 106614 | AA458934 | Hs.179912 | ESTs | 10.9 |
| 107115 | AA610108 | Hs. 27693 | ESTs, Highly similar to CGI-124 protein [H.sa | 10.9 |
| 115764 | AA421562 | Hs. 91011 | anterior gradient 2 (Xenepus laevis) homolog | 10.9 |
| 121770 | AA421714 | Hs. 11469 | KIAA0896 protein | 10.9 |
| 132191 | AA449431 | Hs. 158688 | KIAA0741 gene product | 10.9 |
| 133214 | Y10659 | Hs. 250911 | interleukin 13 receptor, alpha 1 | 10.9 |
| 133914 | N32811 | Hs.77542 | ESTs | 10.8 |
| 101973 | S82597 | Hs. 80120 | UDP-N-acetyl-alpha-D-galactosamine: polypeptid | 10.8 |
| 102669 | U71207 | Hs. 29279 | eyes absent (Drosophila) homolog 2 | 10.8 |
| 104147 | AA451992 | Hs. 226799 | ESTs, Highly similar to HSPC039 protein [H.sa | 10.8 |
| 106474 | AA450212 | Hs. 42484 | Homo sapiens mRNA, cDNA DKFZp564C053 (from cl | 10.8 |
| 115881 | AA435577 | Hs.184942 | G protein-coupled receptor 64 | 10.8 |
| 129950 | M31516 | Hs.1369 | decay accelerating factor for complement (CD5 | 10.8 |
| 132783 | N74897 | Hs. 5683 | DEAD/H (Asp-Glu-Ala-Asp/His) box polypeptide | 10.8 |
| 133784 | AA214305 | Hs. 76173 | ESTs | 10.8 |
| 134248 | AA292677 | Hs. 80624 | ESTs | 10.8 |

TABLE 9A-continued

382 UP-REGULATED GENES, OVARIAN CANCER VERSUS NORMAL OVARY

| Pkey | Ex Accn | UG ID | Title | ratio |
|---|---|---|---|---|
| 105565 | AA278302 | Hs. 18349 | ESTs, Weakly similar to partial CDS [C.elegan | 10.8 |
| 127999 | AA837495 | Hs. 69851 | ESTs; Weakly similar to Wiskott-Aldrich syndr | 10.8 |
| 108040 | AA041551 | Hs.48644 | ESTs | 10.7 |
| 130367 | Z38501 | Hs. 8768 | ESTs, Weakly similar to !!!! ALU SUBFAMILY SQ | 10.7 |
| 108539 | AA084677 | Hs. 54558 | ESTs, Weakly similar to protein B [*H. sapiens*] | 10.7 |
| 111345 | N89820 | Hs. 14559 | ESTs | 10.7 |
| 115583 | AA398913 | Hs. 45231 | LDOC1 protein | 10.7 |
| 128965 | T17440 | Hs. 107418 | ESTs | 10.7 |
| 101396 | M15796 | Hs. 78996 | proliferating cell nuclear antigen | 10.6 |
| 132164 | U84573 | Hs. 41270 | procollagen-lysine, 2-oxoglutarate 5-dioxygen | 10.6 |
| 101275 | L37936 | Hs. 3273 | Ts translation elongation factor, mitochondn | 10.6 |
| 104660 | AA007160 | Hs.14846 | *Homo sapiens* mRNA, cDNA DKFZp564D016 (from cl | 10.6 |
| 108609 | AA100694 | Hs.69499 | Human DNA sequence from BAC 15E1 on chromosom | 10.6 |
| 112041 | R43300 | Hs. 22929 | ESTs | 10.6 |
| 114208 | Z39301 | Hs.7859 | ESTs | 10.6 |
| 118537 | N67974 | Hs. 75431 | fibrinogen, gamma polypeptide | 10.6 |
| 106919 | AA490885 | Hs. 21766 | ESTs | 10.6 |
| 115984 | AA447687 | Hs.91109 | ESTs | 10.6 |
| 105538 | AA258860 | Hs. 32597 | ring finger protein (C3H2C3 type) 6 | 10.6 |
| 102200 | U21551 | Hs. 157205 | branched chain aminotransferase 1, cytosolic | 10.5 |
| 116710 | F10577 | Hs.70312 | ESTs | 10.5 |
| 119780 | W72967 | Hs. 191381 | ESTs, Weakly similar to hypothetical protein | 10.5 |
| 112996 | T23539 | Hs. 7165 | zinc finger protein 259 | 10.5 |
| 103029 | X54489 | Hs. 789 | GRO1 oncogene (melanoma growth stimulating ac | 10.5 |
| 101255 | L34600 | Hs. 149894 | mitochondrial translational initiation factor | 10.4 |
| 107032 | AA599472 | Hs.247309 | succinate-CoA ligase, GDP-foming; beta subun | 10.4 |
| 125617 | AI287461 | Hs. 164950 | ESTs | 10.4 |
| 131475 | Z39053 | Hs. 27263 | ESTs | 10.4 |
| 132073 | N67408 | Hs. 38516 | ESTs | 10.4 |
| 101469 | M22877 | Hs. 169248 | Human somatic cytochrome c (HCS) gene, comple | 10.3 |
| 102437 | U46569 | Hs. 221986 | aquaporin 5 | 10.3 |
| 104301 | D45332 | Hs. 6783 | ESTs | 10.3 |
| 127236 | AI341818 | Hs.98658 | budding uninhibited by benzimidazoles 1 (yeas | 10.3 |
| 101465 | M22612 | Hs. 241395 | protease, serine; 1 (trypsin 1) | 10.3 |
| 113805 | W42957 | Hs. 250617 | ESTs | 10.2 |
| 133536 | Y00264 | Hs. 177486 | amyloid beta (A4) precursor protein (protease | 10.2 |
| 109799 | F10770 | Hs.180378 | *Homo sapiens* clone 669 unknown mRNA, complete | 10.2 |
| 113523 | T90037 | Hs. 16686 | ESTs | 10.2 |
| 116195 | AA465148 | Hs. 72402 | ESTs | 10.2 |
| 134542 | X57025 | Hs. 85112 | insulin-like growth factor 1 (somatomedin C) | 10.2 |
| 125298 | Z39255 | Hs.235350 | YDD19 protein | 10.2 |
| 119367 | T78324 | Hs. 90905 | ESTs | 10.2 |
| 134470 | X54942 | Hs. 83758 | CDC28 protein kinase 2 | 10.2 |
| 134288 | AA430008 | Hs. 8117 | ESTs | 10.1 |
| 105127 | AA158132 | Hs. 11817 | ESTs, Weakly similar to contains similarity t | 10.1 |
| 110627 | H70485 | Hs. 35225 | ESTs; Weakly similar to MBNL protein [H.sapie | 10.1 |
| 115188 | AA261819 | Hs.88367 | ESTs | 10.1 |
| 132632 | N59764 | Hs. 5398 | guanine-monophosphate synthetase | 10.1 |
| 124049 | F10523 | Hs. 74519 | primase, polypeptide 2A (58 kD) | 10.1 |
| 100079 | AB002365 | Hs. 23311 | KIAA0367 protein | 10.0 |
| 113987 | W87494 | Hs. 9641 | ESTs; Moderately similar to COMPLEMENT C1Q SU | 10.0 |
| 117280 | N22107 | Hs. 172241 | ESTs | 10.0 |

Pkey: Primekey
Ex. Accn: Exemplar Accession
UG ID: UniGene ID
Title: UniGene title
ratio: ratio tumor vs normal tissues

TABLE 9B

| Pkey | CAT Number | Accession |
|---|---|---|
| 100661 | 23182_1 | BE623001 L05096 AA383604 AW966416 N53295 AA460213 AW571519 AA603655 |
| 101332 | 25130_1 | J04088 NM_001067 AF071747 AJ011741 N85424 AL042407 AA218572 BE296748 BE083981 AL040877 AW499918 AW675045 H17813 BE081283 AA670403 AW504327 BE094229 AA104024 AI471482 AI970337 AA737616 AI827444 AW003286 AI742333 AI344044 AI765634 AI948838 AW235336 AW172827 AA095289 BE046383 AI734240 W16699 AI660329 AI289433 AA933778 AW469242 AA468838 |

TABLE 9B-continued

| Pkey | CAT Number | Accession |
|---|---|---|
| | | AA806983 AA625873 W78031 BE206307 AA550803 AI743147 AI990075 |
| | | AA948274 AA129533 AI635399 AA605313 AI624669 AW594319 |
| | | AI221834 AI337434 AA307706 BE550282 AI760467 AI630636 |
| | | AI221521 AW674314 AW078889 AI933732 AI686969 AI186928 AW074595 |
| | | AI127486 AL079644 AI910815 H17814 AA310903 AW137854 T19279 |
| | | AA026682 AA306035 AW383390 AW383389 AW383422 AW383427 |
| | | AW383395 H09977 AA306247 AA352501 AW403639 F05421 AA224473 |
| | | AA305321 H93904 AA089612 AW391543 AW402915 AW173382 |
| | | AW402701 AW403113 R94438 N73126 H93466 AA090928 AA095051 |
| | | T29025 AW951071 L47277 L47276 AI375913 BE384156 W24652 |
| | | AA746288 AA568223 BE090591 H93033 N57027 AA504348 AA327653 |
| | | AW959913 N53767 AA843715 AI453437 AW263710 AI076594 |
| | | AA583483 AW873194 AW575166 AI128799 AI803319 AL042776 AW07431 |
| | | AI887722 AI032284 AA447521 AI123885 N29334 AI354911 |
| | | AW090687 AA236763 AA435535 AA236910 AA047124 AA236734 AW514610 |
| | | H93467 AA962007 AI446783 AA127259 AI613495 |
| | | AI686720 AI587374 AA936731 AA702453 AI859757 AA216786 |
| | | AI251819 AI469227 AA806022 AI092324 N71868 AA968782 AA236919 |
| | | AA809450 AA227220 AA765284 AI192007 AA768810 AA805794 |
| | | AA729280 AA806238 AW768817 N71879 AI050686 AA505822 |
| | | AA668974 AI688160 BE045915 AW466315 AA731314 AA649568 |
| | | AA834316 AW591901 AW063876 AW294770 AI300266 AI336094 |
| | | AI560380 AA721755 H09978 D20305 D29155 AW821790 BE150864 |
| | | F01675 AI457474 AW466316 AA550969 AA630788 |
| 100824 | 5_36 | AI393237 AI521317 AI761348 AF025841 D43968 AW994987 L34598 |
| | | AF025841 D89789 D89788 D89790 AW998932 AI971742 AI310238 |
| | | X90976 AW139668 AW674280 AI365552 AA877452 AV657554 |
| | | C75229 AA376077 AI798056 AW609213 W25586 H30149 BE075089 |
| | | BE075190 AW580858 H99598 AA425238 AA133916 AW363478 |
| | | BE158121 BE158127 AW467960 BE158135 BE158126 BE158145 |
| | | N92860 AA847246 AI961688 AI361423 AA878154 AA043767 |
| | | AI863712 AI559226 AW339007 AI371266 AI368901 AA046624 AA134739 |
| | | AW449154 AA130232 AI458720 AA962511 AI700627 R70437 |
| | | AW004008 AA045229 AI671572 H99599 AA043768 AI685454 AI871685 |
| | | N29937 X90977 AA524240 AI142114 AI825750 AI567805 AI631365 |
| | | AI347893 AA134740 F20669 AA046707 AW793216 AW963298 |
| | | AW959380 AA363265 AI784593 AI268201 R69451 AV657618 AI695588 |
| 101714 | 30725_1 | M68874 AL022147 M72393 AL049797 BE439441 T27650 AI260490 AW150345 |
| | | AW778943 AI627464 BE439479 AA587049 AI277900 |
| | | AI984983 AI630935 |
| 101809 | 32963_1 | M86849 AA315280 NM_004004 AA315269 BE142653 AA461400 |
| | | AW802042 BE152893 AW383155 AA490688 AW117930 AW384563 |
| | | AW384544 AW384566 AW378307 AW378323 AW839085 AA257102 |
| | | AW378317 AW276060 AW271245 AW378298 AW384497 AI598114 |
| | | AW264544 AI018136 AW021810 AA961504 AW086214 AW771489 |
| | | AW192483 AI290266 AW192488 AW384490 AW007451 AW890895 |
| | | AA554460 AA613715 AW020066 AI783695 AI589498 AI917637 |
| | | AW264471 AW384491 AI816732 AW368530 AW368521 AW368463 |
| | | AA461087 AI341438 AI970613 AI040737 AI418400 AA947181 |
| | | AA962716 AI280695 AW769275 AW023591 AI160977 AA055400 N71882 |
| | | AA490466 AW243772 AW316636 AI076554 AW511702 N69323 H88912 |
| | | AA257017 AI952506 H88913 AI912481 AA600714 BE465701 |
| | | N64149 C00523 N64240 AA677120 |
| 101923 | 30543_1 | X99133 X83006 W38398 AA401137 AA298242 AA366738 AA308126 AW583781 |
| | | AA298668 AW845024 BE140204 AW845005 U47734 |
| | | AA837575 NM_005564 AA329732 AA421943 BE171567 S75256 |
| | | AI750047 AI762213 AA100735 AW612993 AI474120 AW062884 |
| | | AI940001 AW062852 AW062899 BE182639 AW778875 AA528093 |
| | | AW517424 AI939989 AA076188 BE182636 AA169569 AA167439 |
| | | AI283967 AA167783 AA076140 AI749649 AA166792 AI708618 |
| | | AA400973 AA514773 AA514789 AA164458 AA167440 AA074845 |
| | | AA421944 AA514874 AA079557 AA102361 AA587027 AA642930 |
| | | AA878029 AA164459 AW176400 AW475086 AA857522 AA148193 |
| | | AA838234 AA593897 AI284506 AW193324 AA148194 AW583341 |
| | | AI669077 AW264913 AA074902 AI680515 AA169874 AA169614 |
| | | AA079651 AW591737 AW190644 AA076565 AA662747 AA075896 |
| | | AA535642 N27757 AI306666 AA074727 N79823 AA524360 AI826800 |
| | | AA173827 BE140374 BE004062 AW265060 BE184103 AI199258 |
| | | AA857853 AA299459 AA837890 AI626104 AA503624 BE183618 |
| | | BE183717 AA573267 AI833071 AW270590 AA506601 BE004010 |
| | | AA837854 AI675895 AI810491 AI184883 AW664712 AA076046 |
| | | AA515574 AW352267 AI797418 AA172395 AI749194 AI559933 |
| | | AA502597 AA321220 AI866124 AI695633 AA494293 AW085635 |
| | | AA165649 AA165663 |

TABLE 9B-continued

| Pkey | CAT Number | Accession |
|---|---|---|
| 127007 | 19921_1 | AB037771 BE005079 AA394189 AW959650 AA299360 AA398081 W37627 AW750817 AW630138 AI522058 BE326323 AA374890 AW418534 AW997510 AW995214 AW959649 AA504426 D79223 D79621 AI276062 AI973155 AA653470 AA337887 AI382521 AW084427 D57078 W37628 AI610506 Z30230 AI567034 AA766091 H25097 H25078 AW991507 AA319736 |
| 110769 | 229824_1 | BE000831 AA541787 AW173038 AA327931 AW117510 AW664665 AI066624 AI478955 AI863075 AI073744 AA490170 R46651 AI075653 F02865 N22222 AW972956 |
| 120695 | 9683_3 | AA976503 AI917802 AA953664 AA404613 AA428771 BE280542 AW194691 AI927301 AI740458 AI796100 AI935603 AW052210 AA970201 AI633384 AA425910 AI017004 AI241295 AA402816 AA291468 |

Pkey. Unique Eos probeset identifier number
CAT number Gene cluster number
Accession Genbank accession numbers Table 10A lists about 733 genes up-regulated in ovarian cancer compared to normal adult tissues These were selected from 59680 probesets on the Affymetrix/Eos-Hu03 Gene-Chip array such that the ratio of "average" ovarian cancer to "average" normal adult tissues was greater than or equal to 3 0 The "average" ovarian cancer level was set to the about the 80th percentile amongst various ovarian cancers The "average" normal adult tissue level was set to the 90th percentile value amongst various non-malignant tissues. In order to remove gene-specific background levels of non-specific hybridization, the 15th percentile value amongst the non-malignant tissues was subtracted from both the numerator and the denominator before the ratio was evaluated.

TABLE 10A

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 432938 | T27013 | Hs. 3132 | steroidogenic acute regulatory protein | 56.1 |
| 418179 | X51630 | Hs.1145 | Wilms tumor 1 | 33.5 |
| 400292 | AA250737 | Hs. 72472 | BMPR-lb, bone morphogenetic protein receptor | 30.0 |
| 452838 | U65011 | Hs. 30743 | Preferentially expressed antigen in melanoma | 29.5 |
| 415511 | AI732617 | Hs. 182362 | ESTs | 28.1 |
| 422956 | BE545072 | Hs.122579 | ESTs | 28.1 |
| 410929 | H47233 | Hs. 30643 | ESTs | 27.4 |
| 400289 | X07820 | Hs. 2258 | Matrix Metalloproteinase 10 (Stromolysin 2) | 25.2 |
| 449034 | AI624049 | Hs. 277523 | gb: ts41a09x1 NCI_CGAP_Ut1 *Homo sapiens* cDNA | 23.7 |
| 427585 | D31152 | Hs.179729 | collagen, type X, alpha 1 (Schmid metaphyseal | 22.7 |
| 428392 | H10233 | Hs. 2265 | secretory granule, neuroendocrine protein 1 | 21.9 |
| 448243 | AW369771 | Hs. 77496 | ESTs | 21.3 |
| 430691 | C14187 | Hs. 103538 | ESTs | 21.2 |
| 444783 | AK001468 | Hs. 62180 | ESTs | 20.8 |
| 407638 | AJ404672 | Hs. 288693 | EST | 20.1 |
| 423739 | AA398155 | Hs.97600 | ESTs | 19.7 |
| 436982 | A8018305 | Hs. 5378 | spondin 1, (f-spondin) extracellular matrix p | 19.0 |
| 451110 | AI955040 | Hs. 301584 | ESTs | 18.8 |
| 426427 | M86699 | Hs. 169840 | TTK protein kinase | 18.7 |
| 428227 | AA321649 | Hs. 2248 | INTERFERON-GAMMA INDUCED | 18.3 |
| 419854 | AW664873 | Hs.87836 | *Homo sapiens* PAC clone RP5-1087M19 from 7q11 | 18.3 |
| 439706 | AW872527 | Hs. 59761 | ESTs | 18.3 |
| 428579 | NM_005756 | Hs. 184942 | G protein-coupled receptor 64 | 17.4 |
| 410247 | AF181721 | Hs.61345 | RU2S | 17.0 |
| 428153 | AW513143 | Hs.98367 | hypothetical protein FLJ22252 similar to SRY- | 16.9 |
| 415076 | NM_000857 | Hs. 77890 | guanylate cyclase 1, soluble, beta 3 | 16.6 |
| 416209 | AA236776 | Hs. 79078 | MAD2 (mitotic arrest deficient, yeast, homolo | 16.6 |
| 424905 | NM_002497 | Hs. 153704 | NIMA (never in mitosis gene a)-related kinase | 16.2 |
| 423685 | BE350494 | Hs. 49753 | *Homo sapiens* mRNA for KIAA1561 protein, parti | 15.9 |
| 428187 | AI687303 | Hs. 285529 | ESTs | 15.9 |
| 438817 | AI023799 | Hs. 163242 | ESTs | 15.9 |
| 424906 | AI566086 | Hs.153716 | *Homo sapiens* mRNA for Hmob33 protein, 3' untr | 15.9 |
| 407721 | Y12735 | Hs. 38018 | dual-specificity tyrosine-(Y)-phosphorylation | 15.7 |
| 412723 | AA648459 | Hs. 179912 | ESTs | 15.3 |
| 424717 | H03754 | Hs. 152213 | wingless-type MMTV integration site family, m | 15.2 |
| 443646 | AI085198 | Hs. 298699 | ESTs | 15.1 |
| 424345 | AK001380 | Hs. 145479 | *Homo sapiens* cDNA FLJ10518 fis, clone NT2RP20 | 14.8 |
| 428976 | AL037824 | Hs. 194695 | ras homolog gene family, member 1 | 14.6 |
| 418738 | AW388633 | Hs. 6682 | solute carrier family 7, member 11 | 14.3 |
| 428479 | Y00272 | Hs. 184572 | cell division cycle 2, G1 to S and G2 to M | 14.2 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 436209 | AW850417 | Hs. 254020 | ESTs, Moderately similar to unnamed protein p | 14.1 |
| 427356 | AW023482 | Hs. 97849 | ESTs | 13.9 |
| 418601 | AA279490 | Hs. 86368 | calmegin | 13.8 |
| 416661 | AA634543 | Hs. 79440 | IGF-II mRNA-binding protein 3 | 13.7 |
| 428532 | AF157326 | Hs. 184786 | TBP-interacting protein | 13.6 |
| 402408 | | | 0 | 13.6 |
| 447350 | AI375572 | Hs. 172634 | ESTs, HER4 (c-erb-B4) | 13.4 |
| 451807 | W52854 | Hs. 27099 | DKFZP564J0863 protein | 13.4 |
| 423575 | C18863 | Hs. 163443 | ESTs | 13.2 |
| 443211 | AI128388 | Hs.143655 | ESTs | 13.2 |
| 437872 | AK002015 | Hs. 5887 | RNA binding motif protein 7 | 13.0 |
| 451659 | BE379761 | Hs. 14248 | ESTs, Weakly similar to ALU8_HUMAN ALU SUBFAM | 12.7 |
| 452904 | AL157581 | Hs. 30957 | *Homo sapiens* mRNA, cDNA DKFZp434E0626 (from c | 12.7 |
| 442655 | AW027457 | Hs.30323 | ESTs | 12.5 |
| 452096 | BE394901 | Hs. 226785 | ESTs | 12.4 |
| 414972 | BE263782 | Hs.77695 | KIAA0008 gene product | 12.3 |
| 435039 | AW043921 | Hs. 130526 | ESTs | 12.3 |
| 447033 | AI357412 | Hs. 157601 | EST —not in UniGene | 12.3 |
| 433764 | AW753676 | Hs. 39982 | ESTs | 12.2 |
| 442611 | BE077155 | Hs.177537 | ESTs | 12.0 |
| 408562 | AI436323 | Hs. 31141 | *Homo sapiens* mRNA for KIAA1568 protein, parti | 11.9 |
| 427344 | NM_000869 | Hs. 2142 | 5-hydroxytryptamine (serotonin) receptor 3A | 11.8 |
| 421478 | AI683243 | Hs. 97258 | ESTs | 11.8 |
| 426635 | BE395109 | Hs. 129327 | ESTs | 11.8 |
| 415989 | AI267700 | Hs. 111128 | ESTs | 11.7 |
| 433159 | AB035898 | Hs.150587 | kinesin-like protein 2 | 11.5 |
| 452249 | BE394412 | Hs.61252 | ESTs | 11.4 |
| 418506 | AA084248 | Hs. 85339 | G protein-coupled receptor 39 | 11.3 |
| 442353 | BE379594 | Hs.49136 | ESTs | 11.3 |
| 447700 | AI420183 | Hs. 171077 | ESTs, Weakly similar to similar to serine/thr | 11.3 |
| 450480 | X82125 | Hs. 25040 | zinc finger protein 239 | 11.3 |
| 425176 | AW015644 | Hs. 301430 | ESTs, Moderately similar to TEF1_HUMAN TRANSC | 11.2 |
| 435496 | AW840171 | Hs.265398 | ESTs, Weakly similar to transformation-relate | 11.2 |
| 433133 | AB027249 | Hs. 104741 | PDZ-binding kinase; T-cell originated protein | 11.1 |
| 445258 | AI635931 | Hs. 147613 | ESTs | 11.1 |
| 432677 | NM_004482 | Hs. 278611 | UDP-N-acetyl-alpha-D-galactosamine polypeptid | 11.0 |
| 429782 | NM_005754 | Hs. 220689 | Ras-GTPase-activating protein SH3-domain-bind | 10.9 |
| 404567 | | | 0 | 10.8 |
| 423811 | AW299598 | Hs. 50895 | homeo box C4 | 10.7 |
| 452891 | N75582 | Hs. 212875 | ESTs, Weakly similar to KIAA0357 [*H. sapiens*] | 10.6 |
| 441627 | AA947552 | Hs. 58086 | ESTs | 10.3 |
| 443555 | N71710 | Hs. 21398 | ESTs, Moderately similar to GNPI_HUMAN GLUCOS | 10.3 |
| 412140 | AA219691 | Hs.73625 | RAB6 interacting, kinesin-like (rabkinesin6) | 10.2 |
| 427469 | AA403084 | Hs. 269347 | ESTs | 10.1 |
| 415227 | AW821113 | Hs. 72402 | ESTs | 10.1 |
| 445413 | AA151342 | Hs. 12677 | CGI-147 protein | 10.0 |
| 425734 | AF056209 | Hs. 159396 | peptidylglycine alpha-amidating monooxygenase | 10.0 |
| 421451 | AA291377 | Hs. 50831 | ESTs | 10.0 |
| 410044 | BE566742 | Hs.58169 | highly expressed in cancer, rich in leucine h | 9.8 |
| 427878 | C05766 | Hs. 181022 | CGI-07 protein | 9.7 |
| 408460 | AA054726 | Hs. 285574 | ESTs | 9.7 |
| 422972 | N59319 | Hs. 145404 | ESTs | 9.7 |
| 443715 | AI583187 | Hs. 9700 | cyclin E1 | 9.7 |
| 440901 | AA909358 | Hs.128612 | ESTs | 9.6 |
| 453160 | AI263307 | Hs. 146228 | ESTs | 9.6 |
| 415211 | R64730.comp | Hs.155986 | ESTs; Highly similar to SPERM SURFACE PROTEIN | 9.5 |
| 425282 | AW163518 | Hs.155485 | huntingtin interacting protein 2 | 9.5 |
| 400250 | | | 0 | 9.5 |
| 410568 | AW162948 | Hs. 64542 | pre-mRNA cleavage factor Im (68 kD) | 9.3 |
| 442957 | AI949952 | Hs. 49397 | ESTs | 9.3 |
| 453922 | AF053306 | Hs. 36708 | budding uninhibited by benzimidazoles 1 (yeas | 9.3 |
| 434401 | AI864131 | Hs. 71119 | Putative prostate cancer tumor suppressor | 9.2 |
| 453628 | AW243307 | Hs.170187 | ESTs | 9.1 |
| 452055 | AI377431 | Hs.293772 | ESTs | 9.1 |
| 424086 | AI351010 | Hs. 102267 | lysyl oxidase | 9.1 |
| 442875 | BE623003 | Hs. 23625 | *Homo sapiens* clone TCCCTA00142 mRNA sequence | 9.1 |
| 416208 | AW291168 | Hs. 41295 | ESTs | 9.0 |
| 407168 | R45175 | Hs. 117183 | gb: yg40f01 s1 Soares infant brain 1NIB Homo s | 9.0 |
| 445537 | AJ245671 | Hs. 12844 | EGF-like-domain, multiple 6 | 8.9 |
| 409269 | AA576953 | Hs. 22972 | *Homo sapiens* cDNA FLJ13352 fis, clone OVARC10 | 8.9 |
| 433527 | AW235613 | Hs. 133020 | ESTs | 8.9 |
| 409928 | AL137163 | Hs.57549 | hypothetical protein dJ473B4 | 8.8 |
| 423020 | AA383092 | Hs. 1608 | replication protein A3 (14 kD) | 8.7 |
| 425665 | AK001050 | Hs. 159066 | ESTs | 8.6 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 443204 | AW205878 | Hs. 29643 | *Homo sapiens* cDNA FLJ13103 fis, clone NT2RP30 | 8.6 |
| 449433 | AI672096 | Hs. 9012 | ESTs | 8.6 |
| 453878 | AW964440 | Hs. 19025 | ESTs | 8.6 |
| 450505 | NM_004572 | Hs.25051 | plakophilin 2 | 8.6 |
| 407001 | U12471 | Hs.247954 | Human thrombospondin-1 gene, partial cds | 8.5 |
| 414315 | Z24878 | | gb: HSB65D052 STRATAGENE Human skeletal muscle | 8.5 |
| 425492 | AL021918 | Hs. 158174 | zinc finger protein 184 (Kruppel-like) | 8.5 |
| 435181 | AA669339 | Hs. 28838 | KIAA1571 protein | 8.5 |
| 436396 | AI683487 | Hs. 299112 | *Homo sapiens* cDNA FLJ11441 fis, clone HEMBA10 | 8.5 |
| 418384 | AW149266 | Hs. 25130 | ESTs | 8.4 |
| 453370 | AI470523 | Hs. 182356 | ESTs, Moderately similar to translation initi | 8.4 |
| 409041 | AB033025 | Hs. 50081 | KIAA1199 protein | 8.4 |
| 447078 | AW885727 | Hs. 301570 | ESTs | 8.4 |
| 448674 | W31178 | Hs. 154140 | ESTs | 8.3 |
| 433393 | AF038564 | Hs. 98074 | atrophin-1 interacting protein 4 | 8.3 |
| 433496 | AF064254 | Hs. 49765 | VERY-LONG-CHAIN ACYL-COA SYNTHETASE | 8.3 |
| 421155 | H87879 | Hs. 102267 | lysyl oxidase | 8.2 |
| 438394 | BE379623 | Hs.27693 | CGI-124 protein | 8.2 |
| 400298 | AA032279 | Hs. 61635 | STEAP1 | 8.1 |
| 409092 | AI735283 | Hs. 172608 | ESTs | 8.1 |
| 440250 | AA876179 | Hs. 134650 | ESTs | 8.1 |
| 409143 | AW025980 | Hs. 138965 | ESTs | 8.1 |
| 407771 | AL138272 | Hs. 62713 | ESTs | 8.1 |
| 419088 | AI538323 | Hs.77496 | ESTs | 8.1 |
| 431725 | X65724 | Hs. 2839 | Norrie disease (pseudoglioma) | 7.9 |
| 431750 | AA514986 | Hs. 283705 | ESTs | 7.9 |
| 435635 | AF220050 | Hs. 181385 | uncharacterized hematopoietic stem/progenitor | 7.9 |
| 441826 | AW503603 | Hs.129915 | phosphotriesterase related | 7.9 |
| 417728 | AW138437 | Hs. 24790 | KIAA1573 protein | 7.8 |
| 418845 | AA852985 | Hs. 89232 | chromobox homolog 5 (Drosophila HP1 alpha) | 7.8 |
| 421039 | NM_003478 | Hs. 101299 | cullin 5 | 7.8 |
| 446999 | AA151520 | Hs.279525 | hypothetical protein PRO2605 | 7.8 |
| 429609 | AF002246 | Hs. 210863 | cell adhesion molecule with homology to L1CAM | 7.8 |
| 415139 | AW975942 | Hs. 48524 | ESTs | 7.7 |
| 450192 | AA263143 | Hs.24596 | RAD51-interacting protein | 7.7 |
| 423992 | AW898292 | Hs.137206 | *Homo sapiens* mRNA; cDNA DKFZp564H1663 (from c | 7.7 |
| 436211 | AK001581 | Hs. 80961 | polymerase (DNA directed), gamma | 7.7 |
| 450101 | AV649989 | Hs. 24385 | Human hbc647 mRNA sequence | 7.5 |
| 426921 | AA037145 | Hs. 172865 | cleavage stimulation factor, 3' pre-RNA, subu | 7.5 |
| 433330 | AW207084 | Hs.132816 | ESTs | 7.5 |
| 439759 | AL359055 | Hs. 67709 | *Homo sapiens* mRNA full length insert cDNA clo | 7.5 |
| 427660 | AI741320 | Hs. 114121 | *Homo sapiens* cDNA FLJ23228 fis, clone CAE066 | 7.5 |
| 422095 | AI868872 | Hs. 288966 | ceruloplasmin (ferroxidase) | 7.5 |
| 436476 | AA326108 | Hs. 53631 | ESTs | 7.5 |
| 412170 | D16532 | Hs.73729 | very low density lipoprotein receptor | 7.4 |
| 428954 | AF100781 | Hs. 194678 | WNT1 inducible signaling pathway protein 3 | 7.4 |
| 450221 | AA328102 | Hs. 24641 | cytoskeleton associated protein 2 | 7.4 |
| 439262 | AA832333 | Hs. 124399 | ESTs | 7.4 |
| 435420 | AI928513 | Hs. 59203 | ESTs | 7.3 |
| 422892 | AA988176 | Hs.121553 | hypothetical protein FLJ20641 | 7.3 |
| 457030 | AI301740 | Hs. 173381 | dihydropyrimidinase-like 2 | 7.3 |
| 411571 | AA122393 | Hs.70811 | hypothetical protein FLJ20516 | 7.2 |
| 409916 | BE313625 | Hs.57435 | solute carrier family 11 (proton-coupled diva | 7.2 |
| 418007 | M13509 | Hs. 83169 | Matrix metalloprotease 1 (interstitial collag | 7.2 |
| 420900 | AL045633 | Hs. 44269 | ESTs | 7.2 |
| 424001 | W67883 | Hs. 137476 | KIAA1051 protein | 7.2 |
| 400301 | X03635 | Hs. 1657 | Estrogen receptor 1 | 7.1 |
| 400238 | | | 0 | 7.1 |
| 413573 | AI733859 | Hs. 149089 | ESTs | 7.1 |
| 428071 | AF212848 | Hs. 182339 | transcription factor ESE-3B | 7.1 |
| 447164 | AF026941 | Hs. 17518 | *Homo sapiens* cig5 mRNA, partial sequence | 7.1 |
| 453062 | AW207538 | Hs. 61603 | ESTs | 7.1 |
| 456965 | AW131888 | Hs. 172792 | ESTs, Weakly similar to hypothetical protein | 7.1 |
| 442500 | AI819068 | Hs. 209122 | ESTs | 7.1 |
| 446142 | AI754693 | Hs. 145968 | ESTs | 7.0 |
| 417791 | AW965339 | Hs.111471 | ESTs | 7.0 |
| 418524 | AA300576 | Hs. 85769 | acidic 82 kDa protein mRNA | 7.0 |
| 451797 | AW663858 | Hs. 56120 | ESTs | 7.0 |
| 452909 | NM_015368 | Hs. 30985 | pannexin 1 | 7.0 |
| 453616 | NM_003462 | Hs.33846 | dynein, axonemal, light intermediate polypept | 7.0 |
| 436281 | AW411194 | Hs. 120051 | ESTs | 7.0 |
| 449897 | AW819642 | Hs. 24135 | transmembrane protein vezatin, hypothetical p | 6.9 |
| 414142 | AW368397 | Hs. 150042 | ESTs | 6.9 |
| 448776 | BE302464 | Hs. 30057 | transporter similar to yeast MRS2 | 6.9 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 419423 | D26488 | Hs. 90315 | KIAA0007 protein | 6.9 |
| 420908 | AL049974 | Hs.100261 | *Homo sapiens* mRNA, cDNA DKFZp564B222 (from cl | 6.8 |
| 452971 | AI873878 | Hs. 91789 | ESTs | 6.8 |
| 413597 | AW302885 | Hs. 117183 | ESTs | 6.8 |
| 415138 | C18356 | Hs. 78045 | tissue factor pathway inhibitor 2 TFPI2 | 6.8 |
| 437478 | AL390172 | Hs. 118811 | ESTs | 6.7 |
| 425292 | NM_005824 | Hs.155545 | 37 kDa leucine-rich repeat (LRR) protein | 6.7 |
| 421184 | NM_003616 | Hs. 102456 | survival of motor neuron protein interacting | 6.7 |
| 410227 | AB009284 | Hs. 61152 | exostoses (multiple)-like 2 | 6.6 |
| 446608 | N75217 | Hs. 257846 | ESTs | 6.6 |
| 438167 | R28363 | Hs. 24286 | ESTs | 6.6 |
| 445459 | AI478629 | Hs. 158465 | ESTs | 6.6 |
| 452291 | AF015592 | Hs. 28853 | CDC7 (cell division cycle 7, S. cerevisiae, h | 6.6 |
| 410011 | AB020641 | Hs.57856 | PFTAIRE protein kinase 1 | 6.6 |
| 410292 | AA843087 | Hs. 124194 | ESTs | 6.5 |
| 415716 | N59294 | Hs. 301141 | *Homo sapiens* cDNA FLJ11689 fis, clone HEMBA10 | 6.5 |
| 424770 | AA425562 | | gb: zw46e05 r1 Soares_total_fetus_Nb2HF8_9w Ho | 6.5 |
| 438122 | AI620270 | Hs. 129837 | ESTs | 6.5 |
| 439820 | AL360204 | Hs. 283853 | *Homo sapiens* mRNA full length insert cDNA clo | 6.5 |
| 444743 | AA045648 | Hs. 11817 | nudix (nucleoside diphosphate linked moiety X | 6.5 |
| 450638 | AK001826 | Hs.25245 | hypothetical protein FLJ11269 | 6.5 |
| 418203 | X54942 | Hs. 83758 | CDC28 protein kinase 2 | 6.5 |
| 439901 | N73885 | Hs. 124169 | ESTs | 6.5 |
| 428758 | AA433988 | Hs. 98502 | *Homo sapiens* cDNA FLJ14303 fis, clone PLACE20 | 6.4 |
| 404552 | | | 0 | 6.4 |
| 404599 | | | 0 | 6.4 |
| 419503 | AA243642 | Hs.137422 | ESTs | 6.4 |
| 420149 | AA255920 | Hs. 88095 | ESTs | 6.4 |
| 440411 | N30256 | Hs. 156971 | ESTs, Weakly similar to Weak similarity with | 6.4 |
| 449108 | AI140683 | Hs.98328 | ESTs | 6.4 |
| 452097 | AB002364 | Hs. 27916 | ADAM-TS3, a disintegrin-like and metallopr | 6.4 |
| 453619 | H87648 | Hs. 33922 | *H. sapiens* novel gene from PAC 117P20, chromos | 6.4 |
| 410273 | BE326877 | Hs. 281523 | ESTs | 6.3 |
| 434486 | AA678816 | Hs. 117142 | ESTs | 6.3 |
| 454036 | AA374756 | Hs. 93560 | ESTs, Weakly similar to unnamed protein produ | 6.3 |
| 403381 | | | 0 | 6.2 |
| 421308 | AA687322 | Hs. 192843 | ESTs | 6.2 |
| 419346 | AI830417 | | gb: wh94d12x1 NCI_CGAP_CLL1 *Homo sapiens* cDNA | 6.2 |
| 446140 | AA356170 | Hs. 26750 | *Homo sapiens* cDNA FLJ21908 fis, clone HEP038 | 6.2 |
| 453047 | AW023798 | Hs. 286025 | ESTs | 6.2 |
| 442573 | H93366 | Hs.7567 | Branched chain aminotransferase 1, cytosolic, | 6.1 |
| 410102 | AW248508 | Hs. 279727 | ESTs, | 6.1 |
| 410004 | AI298027 | Hs. 299115 | ESTs | 6.1 |
| 413335 | AI613318 | Hs. 48442 | ESTs | 6.1 |
| 424945 | AI221919 | Hs. 173438 | hypothetical protein FLJ10582 | 6.1 |
| 427510 | Z47542 | Hs. 179312 | small nuclear RNA activating complex, polypep | 6.1 |
| 451229 | AW967707 | Hs. 48473 | ESTs | 6.1 |
| 452641 | AW952893 | Hs.237825 | signal recognition particle 72 kD | 6.1 |
| 433172 | AB037841 | Hs. 102652 | hypothetical protein ASH1 | 6.1 |
| 425465 | L18964 | Hs. 1904 | protein kinase C, iota | 6.1 |
| 437117 | AL049256 | Hs. 122593 | ESTs | 6.0 |
| 423440 | R25234 | Hs. 143434 | contactin 1 | 6.0 |
| 430510 | AW162916 | Hs.241576 | hypothetical protein PRO2577 | 6.0 |
| 433252 | AB040957 | Hs. 151343 | KIAA1524 protein | 6.0 |
| 434699 | AA643687 | Hs. 149425 | *Homo sapiens* cDNA FLJ11980 fis, clone HEMBB10 | 6.0 |
| 436954 | AA740151 | Hs.130425 | ESTs | 5.9 |
| 436032 | AA150797 | Hs. 109276 | latexin protein | 5.9 |
| 424590 | AW966399 | Hs. 46821 | hypothetical protein FLJ20086 | 5.9 |
| 444078 | BE246919 | Hs. 10290 | U5 snRNP-specific 40 kDa protein (hPrp8-bindi | 5.9 |
| 418379 | AA218940 | Hs. 137516 | fidgetin-like 1 | 5.9 |
| 438081 | H49546 | Hs.298964 | ESTs | 5.8 |
| 443270 | NM_004272 | Hs. 9192 | Homer, neuronal immediate early gene, 1B | 5.8 |
| 450459 | AI697193 | Hs. 299254 | ESTs | 5.8 |
| 433612 | AF078164 | Hs. 61188 | *Homo sapiens* Ku70-binding protein (KUB3) mRNA | 5.8 |
| 449048 | Z45051 | Hs. 22920 | similar to S68401 (cattle) glucose induced ge | 5.8 |
| 417251 | AW015242 | Hs. 99488 | ESTs, Weakly similar to ORF YKR074w [S.cerevi | 5.7 |
| 429181 | AW979104 | Hs. 294009 | ESTs | 5.7 |
| 454933 | BE141714 | | gb: QV0-HT0101-061099-032-c04 HT0101 Homo sapi | 5.7 |
| 456553 | AA721325 | Hs. 189058 | ESTs, Weakly similar to cAMP-regulated guanin | 5.7 |
| 430371 | D87466 | Hs.240112 | KIAA0276 protein | 5.7 |
| 425371 | D49441 | Hs. 155981 | mesothelin | 5.7 |
| 424513 | BE385864 | Hs. 149894 | mitochondrial translational initiation factor | 5.6 |
| 432015 | AL157504 | Hs.159115 | ESTs | 5.6 |
| 438109 | AI076621 | Hs. 71367 | ESTs, Moderately similar to ALU7_HUMAN ALU SU | 5.6 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
| --- | --- | --- | --- | --- |
| 407137 | T97307 | Hs. 199067 | v-erb-b2 avian erythroblastic leukemia viral | 5.6 |
| 407945 | X69208 | Hs. 606 | ATPase, Cu++ transporting, alpha polypeptide | 5.6 |
| 416565 | AW000960 | Hs. 44970 | ESTs | 5.6 |
| 417830 | AW504786 | Hs.132808 | epithelial cell transforming sequence 2 oncog | 5.5 |
| 419752 | AA249573 | Hs.152618 | ESTs | 5.5 |
| 422093 | AF151852 | Hs.111449 | CGI-94 protein | 5.5 |
| 424583 | AF017445 | Hs. 150926 | fucose-1-phosphate guanylyltransferase | 5.5 |
| 430388 | AA356923 | Hs. 240770 | nuclear cap binding protein subunit 2, 20 kD | 5.5 |
| 452534 | AW083022 | Hs. 149425 | *Homo sapiens* cDNA FLJ11980 fis, clone HEMBB10 | 5.5 |
| 453279 | AW893940 | Hs. 59698 | ESTs | 5.5 |
| 424188 | AW954552 | Hs.142634 | zinc finger protein | 5.5 |
| 453884 | AA355925 | Hs. 36232 | KIAA0186 gene product | 5.5 |
| 424641 | AB001106 | Hs. 151413 | glia maturation factor, beta | 5.5 |
| 444478 | W07318 | Hs.240 | M-phase phosphoprotein 1 | 5.5 |
| 427975 | AI536065 | Hs. 122460 | ESTs | 5.5 |
| 424620 | AA101043 | Hs. 151254 | kallikrein 7 (chymotryptic, stratum corneum) | 5.5 |
| 442914 | AW188551 | Hs. 99519 | *Homo sapiens* cDNA FLJ14007 fis, clone Y79AA10 | 5.5 |
| 417995 | AW974175 | Hs.188751 | ESTs | 5.4 |
| 418946 | AI798841 | Hs.132103 | ESTs | 5.4 |
| 419963 | AA743276 | Hs. 301052 | ESTs | 5.4 |
| 420362 | U79734 | Hs. 97206 | huntingtin interacting protein 1 | 5.4 |
| 422670 | AA371612 | Hs. 115351 | ESTs | 5.4 |
| 432837 | AA310693 | Hs. 279512 | HSPC072 protein | 5.4 |
| 447020 | T27308 | Hs. 16986 | hypothetical protein FLJ11046 | 5.4 |
| 458027 | L49054 | Hs.85195 | ESTs, Highly similar to t(3,5)(q25 1, p34) fus | 5.4 |
| 425217 | AU076696 | Hs. 155174 | CDC5 (cell division cycle 5, S pombe, homolo | 5.4 |
| 422938 | NM_001809 | Hs. 1594 | centromere protein A (17 kD) | 5.4 |
| 450434 | AA166950 | Hs.18645 | ESTs, Weakly similar to partial CDS [C.elegan | 5.4 |
| 438279 | AA805166 | Hs. 165165 | ESTs, Moderately similar to ALU8_HUMAN ALU SU | 5.4 |
| 413384 | NM_000401 | Hs. 75334 | exostoses (multiple) 2 | 5.3 |
| 420328 | Y19062 | Hs. 96870 | staufen (Drosophila, RNA-binding protein) hom | 5.3 |
| 436586 | AI308862 | Hs.167028 | ESTs | 5.3 |
| 435793 | AB037734 | Hs. 4993 | ESTs | 5.3 |
| 422306 | BE044325 | Hs. 227280 | *Homo sapiens* mRNA for Lsm5 protein | 5.3 |
| 425154 | NM_001851 | Hs. 154850 | collagen, type IX, alpha 1 | 5.2 |
| 453293 | AA382267 | Hs. 10653 | ESTs | 5.2 |
| 429944 | R13949 | Hs. 226440 | *Homo sapiens* clone 24881 mRNA sequence | 5.2 |
| 434891 | AA814309 | Hs.123583 | ESTs | 5.2 |
| 415263 | AA948033 | Hs. 130853 | ESTs | 5.2 |
| 409506 | NM_006153 | Hs. 54589 | NCK adaptor protein 1 | 5.2 |
| 412848 | AA121514 | Hs. 70832 | ESTs | 5.2 |
| 421246 | AW582962 | Hs. 300961 | ESTs, Highly similar to AF151805 1 CGI-47 pro | 5.2 |
| 431548 | AI834273 | Hs. 9711 | *Homo sapiens* cDNA FLJ13018 fis, clone NT2RP30 | 5.2 |
| 412719 | AW016610 | Hs. 129911 | ESTs | 5.2 |
| 411945 | AL033527 | Hs.92137 | v-myc avian myelocytomatosis viral oncogene h | 5.1 |
| 424078 | AB006625 | Hs. 139033 | paternally expressed gene 3 | 5.1 |
| 433558 | AA833757 | Hs. 201769 | ESTs | 5.1 |
| 434265 | AA846811 | Hs.130554 | *Homo sapiens* cDNA FLJ23089 fis, clone LNG070 | 5.1 |
| 453911 | AW503857 | Hs. 4007 | Sarcolemmal-associated protein | 5.1 |
| 415539 | AI733881 | Hs. 72472 | BMPR-lb, bone morphogenetic protein receptor | 5.1 |
| 442717 | R88362 | Hs. 180591 | ESTs, Weakly similar to R06F6.5b [*C. elegans*] | 5.1 |
| 432358 | AI093491 | Hs. 72830 | ESTs | 5.0 |
| 409731 | AA125985 | Hs. 56145 | thymosin, beta, identified in neuroblastoma c | 5.0 |
| 419699 | AA248998 | Hs. 31246 | ESTs | 5.0 |
| 420313 | AB023230 | Hs. 96427 | KIAA1013 protein | 5.0 |
| 422505 | AL120862 | Hs. 124165 | ESTs, (HSA)PAP protein (programmed cell deat | 5.0 |
| 425733 | F13287 | Hs. 159388 | *Homo sapiens* clone 23578 mRNA sequence | 5.0 |
| 434160 | BE551196 | Hs.114275 | ESTs | 5.0 |
| 435094 | AI560129 | Hs.277523 | EST | 5.0 |
| 436812 | AW298067 | | gb: UI-H-BW0-ajp-g-09-0-UI s1 NCI_CGAP_Sub6 Ho | 5.0 |
| 432415 | T16971 | Hs. 289014 | ESTs | 4.9 |
| 406117 | | | 0 | 4.9 |
| 438018 | AK001160 | Hs. 5999 | hypothetical protein FLJ10298 | 4.9 |
| 447505 | AL049266 | Hs. 18724 | *Homo sapiens* mRNA, cDNA DKFZp564F093 (from cl | 4.9 |
| 448621 | AI097144 | Hs.5250 | ESTs, Weakly similar to BACR37P7 g [D.melanog | 4.9 |
| 453001 | AW131636 | Hs. 191260 | ESTs | 4.9 |
| 410561 | BE540255 | Hs. 6994 | *Homo sapiens* cDNA FLJ22044 fis, clone HEP091 | 4.9 |
| 418811 | AK001407 | Hs. 88663 | hypothetical protein FLJ10545 | 4.9 |
| 436754 | AI061288 | Hs.133437 | ESTs, Moderately similar to gonadotropin indu | 4.8 |
| 437212 | AI765021 | Hs. 210775 | ESTs | 4.8 |
| 447312 | AI434345 | Hs. 36908 | activating transcription factor 1 | 4.8 |
| 409732 | NM_016122 | Hs. 56148 | NY-REN-58 antigen | 4.8 |
| 434690 | AI867679 | Hs.148410 | ESTs | 4.8 |
| 444172 | BE147740 | Hs. 104558 | ESTs | 4.8 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 424539 | L02911 | Hs. 150402 | activin A receptor, type I | 4.8 |
| 418677 | S83308 | Hs. 87224 | SRY (sex determining region Y)-box 5 | 4.8 |
| 406076 | AL390179 | Hs. 137011 | *Homo sapiens* mRNA, cDNA DKFZp547P134 (from cl | 4.8 |
| 420179 | N74530 | Hs. 21168 | ESTs | 4.7 |
| 450375 | AA009647 | Hs.8850 | a disintegrin and metalloproteinase domain 12 | 4.7 |
| 419247 | S65791 | Hs.89764 | fragile X mental retardation 1 | 4.7 |
| 420850 | BE139590 | Hs. 122406 | ESTs | 4.7 |
| 425420 | BE536911 | Hs. 234545 | ESTs | 4.7 |
| 428664 | AK001666 | Hs. 189095 | similar to SALL1 (sal (Drosophila)-like | 4.7 |
| 419131 | AA406293 | Hs.301622 | ESTs | 4.7 |
| 422278 | AF072873 | Hs. 114218 | ESTs | 4.7 |
| 451684 | AF216751 | Hs. 26813 | CDA14 | 4.6 |
| 400296 | AA305627 | Hs.139336 | ATP-binding cassette, sub-family C (CFTR/MRP) | 4.6 |
| 408425 | AW058674 | Hs. 44787 | *Homo sapiens* mRNA, cDNA DKFZp434O0227 (from c | 4.6 |
| 417168 | AL133117 | Hs. 81376 | *Homo sapiens* mRNA; cDNA DKFZp586L1121 (from c | 4.6 |
| 429486 | AF155827 | Hs. 203963 | hypothetical protein FLJ10339 | 4.6 |
| 442917 | AA314907 | Hs.85950 | ESTs | 4.6 |
| 443268 | AI800271 | Hs. 129445 | hypothetical protein FLJ12496 | 4.6 |
| 452795 | AW392555 | Hs. 18878 | hypothetical protein FLJ21620 | 4.6 |
| 457300 | AW297436 | Hs. 158849 | *Homo sapiens* cDNA FLJ21663 fis, clone COL088 | 4.6 |
| 459551 | AI472808 | | gb: tj70e07.x1 Soares__NSF_F8_9W_OT_PA_P_S1 Hom | 4.6 |
| 421977 | W94197 | Hs.110165 | ribosomal protein L26 homolog | 4.6 |
| 429441 | AJ224172 | Hs. 204096 | lipophilin B (uteroglobin family member), pro | 4.6 |
| 449722 | BE280074 | Hs. 23960 | cyclin B1 | 4.6 |
| 431689 | AA305688 | Hs. 267695 | UDP-Gal betaGlcNAc beta 1,3-galactosyltransfe | 4.5 |
| 425178 | H16097 | Hs. 161027 | ESTs | 4.5 |
| 429597 | NM_003816 | Hs. 2442 | a disintegrin and metalloproteinase domain 9 | 4.5 |
| 436556 | AI364997 | Hs. 7572 | ESTs | 4.5 |
| 400534 | | | 0 | 4.5 |
| 417845 | AL117461 | Hs. 82719 | *Homo sapiens* mRNA, cDNA DKFZp586F1822 (from c | 4.5 |
| 423123 | NM_012247 | Hs. 124027 | SELENOPHOSPHATE SYNTHETASE, Human selenium d | 4.5 |
| 448305 | AA625207 | Hs.264915 | *Homo sapiens* cDNA FLJ12908 fis, clone NT2RP20 | 4.5 |
| 441006 | AW605267 | Hs.7627 | CGI-60 protein | 4.5 |
| 414569 | AF109298 | Hs. 118258 | Prostate cancer associated protein 1 | 4.5 |
| 447924 | AI817226 | Hs. 170337 | ESTs | 4.5 |
| 425506 | NM_003666 | Hs. 158205 | basic leucine zipper nuclear factor 1 (JEM-1) | 4.5 |
| 411630 | U42349 | Hs. 71119 | Putative prostate cancer tumor suppressor | 4.4 |
| 432842 | AW674093 | Hs.279525 | hypothetical protein PRO2605 | 4.4 |
| 413472 | BE242870 | Hs.75379 | solute carrier family 1 (glial high affinity | 4.4 |
| 414699 | AI815523 | Hs. 76930 | synuclein, alpha (non A4 component of amyloid | 4.4 |
| 412733 | AA984472 | Hs. 74554 | KIAA0080 protein | 4.4 |
| 419790 | U79250 | Hs. 93201 | glycerol-3-phosphate dehydrogenase 2 (mitocho | 4.4 |
| 433377 | AI752713 | Hs.43845 | ESTs | 4.4 |
| 449535 | W15267 | Hs. 23672 | low density lipoprotein receptor-related prot | 4.4 |
| 453900 | AW003582 | Hs.226414 | ESTs, Weakly similar to ALU8_HUMAN ALU SUBFAM | 4.4 |
| 443881 | R64512 | Hs.237146 | *Homo sapiens* cDNA FLJ14234 fis, clone NT2RP40 | 4.4 |
| 423025 | AA831267 | Hs. 12244 | *Homo sapiens* cDNA FLJ23581 fis, clone LNG136 | 4.4 |
| 408621 | AI970672 | Hs. 46638 | chromosome 11 open reading frame 8, fetal br | 4.3 |
| 416241 | N52639 | Hs. 32683 | ESTs | 4.3 |
| 432005 | AA524190 | Hs. 120777 | ESTs, Weakly similar to ELL2_HUMAN RNA POLYME | 4.3 |
| 435532 | AW291488 | Hs.117305 | ESTs | 4.3 |
| 451813 | NM_016117 | Hs. 27182 | phospholipase A2-activating protein | 4.3 |
| 454193 | BE141183 | | gb: MR0-HT0071-191199-001-b04 HT0071 Homo sapi | 4.3 |
| 418478 | U38945 | Hs. 1174 | cyclin-dependent kinase inhibitor 2A (melanom | 4.3 |
| 406069 | | | 0 | 4.3 |
| 419465 | AW500239 | Hs. 21187 | *Homo sapiens* cDNA FLJ23068 fis, clone LNG055 | 4.3 |
| 418413 | R95735 | Hs.117753 | ESTs, Weakly similar to antigen of the monocl | 4.3 |
| 452028 | AK001859 | Hs. 27595 | hypothetical protein FLJ10997 | 4.3 |
| 418693 | AI750878 | Hs. 87409 | thrombospondin 1 | 4.3 |
| 410361 | BE391804 | Hs.62661 | guanylate binding protein 1, interferon-induc | 4.2 |
| 409763 | AL043212 | | gb: DKFZp434H0623_r1 434 (synonym htes3) Homo | 4.2 |
| 455601 | AI368680 | Hs. 816 | SRY (sex determining region Y)-box 2, partial | 4.2 |
| 408908 | BE296227 | Hs. 48915 | serine/threonine kinase 15 | 4.2 |
| 413582 | AW295647 | Hs. 71331 | *Homo sapiens* cDNA FLJ21971 fis, clone HEP057 | 4.2 |
| 423248 | AA380177 | Hs.125845 | ribulose-5-phosphate-3-epimerase | 4.2 |
| 425024 | R39235 | Hs. 12407 | ESTs | 4.2 |
| 447153 | AA805202 | Hs. 173912 | eukaryotic translation initiation factor 4A, | 4.2 |
| 447406 | BE618060 | Hs. 282882 | ESTs | 4.2 |
| 449347 | AV649748 | Hs.295901 | ESTs | 4.2 |
| 414279 | AW021691 | Hs. 3804 | DKFZP564C1940 protein | 4.2 |
| 428856 | AA436735 | Hs. 183171 | *Homo sapiens* cDNA FLJ22002 fis, clone HEP066 | 4.2 |
| 407872 | AB039723 | Hs.40735 | frizzled (Drosophila) homolog 3 | 4.2 |
| 421502 | AF111856 | Hs. 105039 | solute carner family 34 (sodium phosphate), | 4.2 |
| 436406 | AW105723 | Hs. 125346 | ESTs | 4.2 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 438209 | AL120659 | Hs. 6111 | KIAA0307 gene product | 4.2 |
| 443653 | AA137043 | Hs.9663 | programmed cell death 6-interacting protein | 4.1 |
| 454556 | AW807073 | | gb: MR4-ST0062-031199-018-d06 ST0062 Homo sapi | 4.1 |
| 424834 | AK001432 | Hs. 153408 | *Homo sapiens* cDNA FLJ10570 fis, clone NT2RP20 | 4.1 |
| 412593 | Y07558 | Hs. 74088 | early growth response 3 | 4.1 |
| 416566 | NM_003914 | Hs. 79378 | cyclin A1 | 4.1 |
| 426342 | AF093419 | Hs. 169378 | multiple PDZ domain protein | 4.1 |
| 428417 | AK001699 | Hs.184227 | F-box only protein 21 | 4.1 |
| 429317 | AA831552 | Hs. 268016 | solute carrier family 5 (inositol transporter | 4.1 |
| 446880 | AI811807 | Hs.108646 | *Homo sapiens* cDNA FLJ12534 fis, clone NT2RM40 | 4.1 |
| 422988 | AW673847 | Hs.97321 | ESTs | 4.0 |
| 434657 | AA641876 | Hs.191840 | ESTs | 4.0 |
| 412494 | AL133900 | Hs. 792 | ADP-ribosylation factor domain protein 1, 64 k | 4.0 |
| 443271 | BE568568 | Hs. 195704 | ESTs | 4.0 |
| 421437 | AW821252 | Hs. 104336 | ESTs | 4.0 |
| 401644 | | | 0 | 4.0 |
| 405095 | | | 0 | 4.0 |
| 418417 | R77182 | | gb: yi65e02 r1 Soares placenta Nb2HP Homo sapi | 4.0 |
| 420807 | AA280627 | Hs. 57846 | ESTs | 4.0 |
| 429529 | AA454190 | Hs. 193811 | ESTs, Moderately similar to reduced expressio | 4.0 |
| 457726 | AI217477 | Hs. 194591 | ESTs | 4.0 |
| 431130 | NM_006103 | Hs. 2719 | epididymis-specific, whey-acidic protein type | 4.0 |
| 453403 | BE466639 | Hs. 61779 | *Homo sapiens* cDNA FLJ13591 fis, clone PLACE10 | 4.0 |
| 442768 | AL048534 | Hs. 48458 | ESTs, Weakly similar to ALU8_HUMAN ALU SUBFAM | 4.0 |
| 413430 | R22479 | Hs. 24650 | *Homo sapiens* cDNA FLJ13047 fis, clone NT2RP30 | 4.0 |
| 424081 | NM_006413 | Hs. 139120 | ribonuclease P (30 kD) | 4.0 |
| 425692 | D90041 | Hs.155956 | NAT1; arylamine N-acetyltransferase | 4.0 |
| 407792 | AI077715 | Hs. 39384 | putative secreted ligand homologous to fjx1 | 4.0 |
| 408353 | BE439838 | Hs. 44298 | hypothetical protein | 4.0 |
| 421175 | AI879099 | Hs.102397 | GIOT-3 for gonadotropin inducible transcripti | 3.9 |
| 420324 | AF163474 | Hs. 96744 | DKFZP586D0823 protein, Prostate androgen-regu | 3.9 |
| 417531 | NM_003157 | Hs. 1087 | serine/threonine kinase 2 | 3.9 |
| 458924 | BE242158 | Hs. 24427 | DKFZP566O1646 protein | 3.9 |
| 400195 | | | 0 | 3.9 |
| 401480 | | | 0 | 3.9 |
| 410360 | AW663690 | | gb: hj21g03 x1 NCI_CGAP_Li8 *Homo sapiens* cDNA | 3.9 |
| 410908 | AA121686 | Hs. 10592 | ESTs | 3.9 |
| 420159 | AI572490 | Hs. 99785 | ESTs | 3.9 |
| 422805 | AA436989 | Hs. 121017 | H2A histone family, member A | 3.9 |
| 424639 | AI917494 | Hs.131329 | ESTs | 3.9 |
| 428555 | NM_002214 | Hs.184908 | integrin, beta 8 | 3.9 |
| 431699 | NM_001173 | Hs. 267831 | *Homo sapiens* cDNA FLJ12952 fis, clone NT2RP20 | 3.9 |
| 433703 | AA210863 | Hs. 3532 | nemo-like kinase | 3.9 |
| 437144 | AL049466 | Hs. 7859 | ESTs | 3.9 |
| 452728 | AI915676 | Hs.239708 | ESTs | 3.9 |
| 430447 | W17064 | Hs. 241451 | SWI/SNF related, matrix associated, action dep | 3.9 |
| 440594 | AW445167 | Hs. 126036 | ESTs | 3.9 |
| 408938 | AA059013 | Hs. 22607 | ESTs | 3.9 |
| 427051 | BE178110 | Hs.173374 | ESTs | 3.9 |
| 447568 | AF155655 | Hs.18885 | CGI-116 protein | 3.9 |
| 457211 | AW972565 | Hs. 32399 | ESTs, Weakly similar to Similar to Ena-VASP I | 3.9 |
| 443475 | AI066470 | Hs. 134482 | ESTs | 3.9 |
| 433447 | U29195 | Hs. 3281 | neuronal pentraxin II | 3.9 |
| 428093 | AW594506 | Hs. 104830 | ESTs | 3.8 |
| 437938 | AI950087 | | ESTs; Weakly similar to Gag-Pol polyprotein [ | 3.8 |
| 408829 | NM_006042 | Hs. 48384 | heparan sulfate (glucosamine) 3-O-sulfotransf | 3.8 |
| 429250 | H56585 | Hs.198308 | tryptophan rich basic protein | 3.8 |
| 441859 | AW194364 | Hs. 128022 | ESTs, Weakly similar to FIG1 MOUSE FIG-1 PROT | 3.8 |
| 437700 | AA766060 | Hs. 122848 | ESTs | 3.8 |
| 439560 | BE565647 | Hs. 74899 | hypothetical protein FLJ12820 | 3.8 |
| 409564 | AA045857 | Hs.54943 | fracture callus 1 (rat) homolog | 3.8 |
| 429474 | AA453441 | Hs. 31511 | ESTs | 3.8 |
| 431965 | BE175190 | | gb: QV2-HT0577-010500-165-g04 HT0577 Homo sapi | 3.8 |
| 454018 | AW016892 | Hs.241652 | ESTs | 3.8 |
| 426320 | W47595 | Hs. 169300 | transforming growth factor, beta 2 | 3.8 |
| 439635 | AA477288 | Hs. 94891 | *Homo sapiens* cDNA FLJ22729 fis, clone HSI156 | 3.8 |
| 417517 | AF001176 | Hs. 82238 | POP4 (processing of precursor, S cerevisiae | 3.8 |
| 446402 | AI681145 | Hs. 160724 | ESTs | 3.8 |
| 450236 | AW162998 | Hs. 24684 | KIAA1376 protein | 3.8 |
| 410804 | U64820 | Hs. 66521 | Machado-Joseph disease (spinocerebellar ataxi | 3.8 |
| 400268 | | | 0 | 3.8 |
| 418217 | AI910647 | Hs.13442 | ESTs | 3.8 |
| 421928 | AF013758 | Hs. 109643 | polyadenylate binding protein-interacting pro | 3.8 |
| 417300 | AI765227 | Hs. 55610 | solute carner family 30 (zinc transporter), | 3.8 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 414136 | AA812434 | Hs. 178227 | ESTs | 3.8 |
| 453945 | NM_005171 | Hs. 36908 | activating transcription factor 1 | 3.7 |
| 400240 | | | 0 | 3.7 |
| 407877 | AW016811 | Hs. 234478 | Homo sapiens cDNA FLJ22648 fis, clone HSI073 | 3.7 |
| 450581 | AF081513 | Hs.25195 | endometrial bleeding associated factor (left- | 3.7 |
| 418223 | NM_014733 | Hs. 83790 | KIAA0305 gene product | 3.7 |
| 411704 | AI499220 | Hs. 71573 | hypothetical protein FLJ10074 | 3.7 |
| 432712 | AB016247 | Hs. 288031 | sterol-C5-desaturase (fungal ERG3, delta-5-de | 3.7 |
| 422809 | AK001379 | Hs.121028 | hypothetical protein FLJ10549 | 3.7 |
| 402820 | | | 0 | 3.7 |
| 408090 | BE173621 | Hs. 292478 | ESTs | 3.7 |
| 416421 | AA134006 | Hs. 79306 | eukaryotic translation initiation factor 4E | 3.7 |
| 418282 | AA215535 | Hs. 98133 | ESTs | 3.7 |
| 418454 | AA315308 | | gb: EST187095 Colon carcinoma (HCC) cell line | 3.7 |
| 418668 | AW407987 | Hs. 87150 | Human clone A9A2BR11 (CAC)n/(GTG)n repeat-con | 3.7 |
| 422290 | AA495854 | Hs.48827 | hypothetical protein FLJ12085 | 3.7 |
| 432824 | AK001783 | Hs. 279012 | hypothetical protein FLJ10921 | 3.7 |
| 439907 | AA853978 | Hs. 124577 | ESTs | 3.7 |
| 447479 | AB037834 | Hs. 18685 | Homo sapiens mRNA for KIAA1413 protein, parti | 3.7 |
| 451073 | AI758905 | Hs. 206063 | ESTs | 3.7 |
| 450377 | AB033091 | Hs. 24936 | ESTs | 3.7 |
| 414343 | AL036166 | Hs. 75914 | coated vesicle membrane protein | 3.7 |
| 448807 | AI571940 | Hs. 7549 | ESTs | 3.7 |
| 442821 | BE391929 | Hs. 8752 | Putative type II membrane protein | 3.7 |
| 426300 | U15979 | Hs.169228 | delta-like homolog (Drosophila) | 3.7 |
| 418068 | AW971155 | Hs.293902 | ESTs, Weakly similar to prolyl 4-hydroxylase | 3.7 |
| 411263 | BE297802 | Hs. 69360 | kinesin-like 6 (mitotic centromere-associated | 3.7 |
| 443054 | AI745185 | Hs. 8939 | yes-associated protein 65 kDa | 3.7 |
| 421154 | AA284333 | Hs. 287631 | Homo sapiens cDNA FLJ14269 fis, clone PLACE10 | 3.7 |
| 411402 | BE297855 | Hs.69855 | NRAS-related gene | 3.7 |
| 450447 | AF212223 | Hs. 25010 | hypothetical protein P15-2 | 3.6 |
| 414706 | AW340125 | Hs. 76989 | KIAA0097 gene product | 3.6 |
| 434228 | Z42047 | Hs. 283978 | ESTs, KIAA0738 gene product | 3.6 |
| 434164 | AW207019 | Hs. 148135 | ESTs | 3.6 |
| 409533 | AW969543 | Hs. 2129 | mitogen-activated protein kinase kinase kinas | 3.6 |
| 402222 | | | 0 | 3.6 |
| 404915 | | | 0 | 3.6 |
| 404996 | | | 0 | 3.6 |
| 411560 | AW851186 | | gb: IL3-CT0220-150200-071-H05 CT0220 Homo sapi | 3.6 |
| 419750 | AL079741 | Hs. 183114 | Homo sapiens cDNA FLJ14236 fis, clone NT2RP40 | 3.6 |
| 426010 | AA136563 | Hs. 1975 | Homo sapiens cDNA FLJ21007 fis, clone CAE038 | 3.6 |
| 427038 | NM_014633 | Hs.173288 | KIAA0155 gene product | 3.6 |
| 439255 | BE164500 | | gb: RC4-HT0469-230300-014-e10 HT0469 Homo sapi | 3.6 |
| 458242 | BE299588 | Hs. 28465 | Homo sapiens cDNA FLJ21869 fis, clone HEP024 | 3.6 |
| 415115 | AA214228 | Hs.127751 | hypothetical protein | 3.6 |
| 453468 | W00712 | Hs. 32990 | DKF7P566F084 protein | 3.6 |
| 441205 | AW137827 | Hs. 176904 | ESTs | 3.6 |
| 452693 | T79153 | Hs. 48589 | zinc finger protein 228 | 3.6 |
| 417389 | BE260964 | Hs. 82045 | Midkine (neunte growth-promoting factor 2) | 3.6 |
| 448105 | AW591433 | Hs.170675 | ESTs, Weakly similar to TMS2_HUMAN TRANSMEMBR | 3.6 |
| 451522 | BE565817 | Hs. 26498 | hypothetical protein FLJ21657 | 3.6 |
| 440048 | AA897461 | Hs. 158469 | ESTs, Weakly similar to envelope protein [H.s | 3.5 |
| 419359 | AL043202 | Hs. 90073 | chromosome segregation 1 (yeast homolog)-like | 3.5 |
| 452030 | AL137578 | Hs. 27607 | Homo sapiens mRNA, cDNA DKFZp564N2464 (from c | 3.5 |
| 400666 | | | 0 | 3.5 |
| 422646 | H87863 | Hs.151360 | ESTs | 3.5 |
| 407846 | AA426202 | Hs. 40403 | Cbp/p300-interacting transactivator, with Glu | 3.5 |
| 408730 | AV660717 | Hs.47144 | DKFZP586N0819 protein | 3.5 |
| 401517 | | | 0 | 3.5 |
| 413775 | AW409934 | Hs. 75528 | nucleolar GTPase | 3.5 |
| 417177 | NM_004458 | Hs. 81452 | fatty-acid-Coenzyme A ligase, long-chain 4 | 3.5 |
| 427943 | AW959075 | | gb: EST371145 MAGE resequences, MAGE Homo sapi | 3.5 |
| 439107 | AL046134 | Hs. 27895 | ESTs | 3.5 |
| 447268 | AI370413 | Hs.36563 | Homo sapiens cDNA FLJ22418 fis, clone HRC085 | 3.5 |
| 412604 | AW978324 | Hs. 47144 | DKFZP586N0819 protein | 3.5 |
| 427134 | AA398409 | Hs. 173561 | EST | 3.5 |
| 430273 | AI311127 | Hs. 125522 | ESTs | 3.5 |
| 436671 | AW137159 | Hs. 146151 | ESTs | 3.5 |
| 433037 | NM_014158 | Hs. 279938 | HSPC067 protein | 3.5 |
| 453745 | AA952989 | Hs. 63908 | Homo sapiens HSPC316 mRNA, partial cds | 3.5 |
| 400531 | AF151064 | Hs. 36069 | hypothetical protein | 3.5 |
| 433345 | AI681545 | Hs. 152982 | EST cluster (not in UniGene) | 3.4 |
| 406400 | AA343629 | Hs. 104570 | kallikrein 8 (neuropain/ovasin) | 3.4 |
| 407596 | R86913 | | gb: yq30f05 r1 Soares fetal liver spleen 1NFLS | 3.4 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 453779 | N35187 | Hs. 43388 | ESTs | 3.4 |
| 444858 | AI199738 | Hs. 208275 | ESTs, Weakly similar to unnamed protein product | 3.4 |
| 447688 | N87079 | Hs. 19236 | NADH dehydrogenase (ubiquinone) 1 beta subcom | 3.4 |
| 424856 | AA347746 | Hs. 9521 | ESTs, Weakly similar to KIAA1015 protein [H.s | 3.4 |
| 407864 | AF069291 | Hs. 40539 | chromosome 8 open reading frame 1 | 3.4 |
| 404108 | | | 0 | 3.4 |
| 403729 | | | 0 | 3.4 |
| 404232 | | | 0 | 3.4 |
| 423687 | AA329633 | Hs.133011 | ESTs, Highly similar to Z117_HUMAN ZINC FINGE | 3.4 |
| 428372 | AK000684 | Hs. 183887 | hypothetical protein FLJ22104 | 3.4 |
| 439741 | BE379646 | Hs. 6904 | *Homo sapiens* mRNA full length insert cDNA clo | 3.4 |
| 441447 | AA934077 | Hs. 126980 | ESTs | 3.4 |
| 448358 | R44433 | Hs.106614 | Human DNA sequence from clone RP4-534K7 on ch | 3.4 |
| 450926 | AI744361 | Hs. 205591 | ESTs, Weakly similar to zinc finger protein P | 3.4 |
| 458477 | NM_000314 | Hs. 10712 | phosphatase and tensin homolog (mutated in mu | 3.4 |
| 421379 | Y15221 | Hs. 103982 | small inducible cytokine subfamily B (Cys-X-C | 3.4 |
| 452822 | X85689 | Hs. 288617 | *Homo sapiens* cDNA FLJ22621 fis, clone HSI056 | 3.4 |
| 441111 | AI806867 | Hs.126594 | ESTs | 3.4 |
| 447519 | U46258 | Hs.23448 | ESTs | 3.4 |
| 446913 | AA430650 | Hs. 16529 | transmembrane 4 superfamily member (tetraspan | 3.4 |
| 449581 | AI989517 | Hs. 181605 | ESTs | 3.4 |
| 456132 | BE219771 | Hs. 237146 | *Homo sapiens* cDNA FLJ14234 fis, clone NT2RP40 | 3.4 |
| 448186 | AA262105 | Hs. 4094 | *Homo sapiens* cDNA FLJ14208 fis, clone NT2RP30 | 3.4 |
| 422611 | AA158177 | Hs. 118722 | fucosyltransferase 8 (alpha (1,6) fucosyltran | 3.4 |
| 441433 | AA933809 | Hs.42746 | ESTs | 3.4 |
| 417837 | AL079905 | Hs. 1103 | transforming growth factor, beta 1 | 3.4 |
| 450516 | AA902656 | Hs. 21943 | NIF3 (Ngg1 interacting factor 3, S pombe homo | 3.4 |
| 407796 | AA195509 | Hs. 272239 | lymphocyte activation-associated protein | 3.3 |
| 419200 | AW966405 | Hs. 288856 | prefoldin 5 | 3.3 |
| 423161 | AL049227 | Hs. 124776 | *Homo sapiens* mRNA, cDNA DKFZp564N1116 (from c | 3.3 |
| 445679 | AI343868 | Hs. 58800 | *Homo sapiens* cDNA FLJ12488 fis, clone NT2RM20 | 3.3 |
| 435014 | BE560898 | Hs. 10026 | ribosomal protein L17 isolog | 3.3 |
| 446619 | AU076643 | Hs.313 | secreted phosphoprotein 1 (osteoporitin, bone | 3.3 |
| 439170 | AA332365 | Hs. 165539 | ESTs | 3.3 |
| 429830 | AI537278 | Hs. 225841 | DKFZP434D193 protein | 3.3 |
| 428943 | AW086180 | Hs. 37636 | ESTs, Weakly similar to KIAA1392 protein [H.s | 3.3 |
| 445817 | NM_003642 | Hs. 13340 | histone acetyltransferase 1 | 3.3 |
| 408805 | H69912 | Hs.48269 | vaccinia related kinase 1 | 3.3 |
| 441134 | W29092 | Hs. 7678 | cellular retinoic acid-binding protein 1 | 3.3 |
| 408532 | AI453137 | Hs. 63176 | ESTs | 3.3 |
| 409517 | X90780 | Hs. 54668 | troponin I, cardiac | 3.3 |
| 414304 | AI621276 | Hs. 165998 | DKEZP564M2423 protein | 3.3 |
| 436427 | AI344378 | Hs. 143399 | ESTs | 3.3 |
| 436662 | AI582393 | Hs. 126695 | ESTs | 3.3 |
| 440304 | BE159984 | Hs.125395 | ESTs | 3.3 |
| 447385 | F12863 | | gb: HSC3FE081 normalized infant brain cDNA Hom | 3.3 |
| 451177 | AI969716 | Hs. 13034 | ESTs | 3.3 |
| 428949 | AA442153 | Hs. 104744 | ESTs, Weakly similar to AF208855 1 BM-013 [H | 3.3 |
| 451743 | AW074266 | Hs. 23071 | ESTs | 3.3 |
| 421515 | Y11339 | Hs. 105352 | GalNAc alpha-2, 6-sialyltransferase I, long f | 3.3 |
| 446351 | AW444551 | Hs.258532 | ESTs | 3.3 |
| 435102 | AW899053 | Hs. 76917 | F-box only protein 8 | 3.3 |
| 418216 | AA662240 | Hs. 283099 | AF15q14 protein | 3.3 |
| 401508 | | | 0 | 3.3 |
| 437108 | AA434054 | Hs. 80624 | *Homo sapiens* cDNA FLJ23442 fis, clone HSI009 | 3.3 |
| 416530 | U62801 | Hs. 79361 | kallikrein 6 (neurosis, zyme) | 3.3 |
| 443171 | BE281128 | Hs. 9030 | TONDU | 3.3 |
| 458627 | AW088642 | Hs.97984 | ESTs; Weakly similar to WASP-family protein [ | 3.3 |
| 412078 | X69699 | Hs. 73149 | paired box gene 8 | 3.3 |
| 414080 | AA135257 | Hs. 47783 | ESTs, Weakly similar to T12540 hypothetical p | 3.3 |
| 401197 | | | 0 | 3.3 |
| 422134 | AW179019 | Hs.112110 | ESTs | 3.3 |
| 409044 | AI129586 | Hs. 33033 | ESTs | 3.3 |
| 416198 | H27332 | Hs. 99598 | ESTs | 3.2 |
| 436481 | AA379597 | Hs. 5199 | HSPC150 protein similar to ubiquitin-conjugat | 3.2 |
| 436525 | AA721428 | Hs. 26145 | *Homo sapiens* cDNA FLJ14127 fis, clone MAMMA10 | 3.2 |
| 409142 | AL136877 | Hs.50758 | chromosome-associated polypeptide C | 3.2 |
| 428819 | AL135623 | Hs.193914 | KIAA0575 gene product | 3.2 |
| 428728 | NM_016625 | Hs. 191381 | ESTs, Weakly similar to hypothetical protein | 3.2 |
| 421261 | AA600853 | Hs. 98133 | ESTs | 3.2 |
| 446219 | AI287344 | Hs. 149827 | ESTs | 3.2 |
| 457574 | H88717 | Hs. 27774 | ESTs, Highly similar to AF161349 I HSPC086 [H | 3.2 |
| 409172 | Z99399 | Hs.118145 | ESTs | 3.2 |
| 419388 | T67012 | Hs. 75323 | prohibitin | 3.2 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 434187 | AA627098 | Hs. 99103 | ESTs, Weakly similar to I38428 T-complex prot | 3.2 |
| 445060 | AA830811 | Hs.88808 | ESTs | 3.2 |
| 448254 | AI829900 | Hs. 22929 | ESTs | 3.2 |
| 452943 | BE247449 | Hs. 31082 | hypothetical protein FLJ10525 | 3.2 |
| 411393 | AW797437 | Hs. 69771 | B-factor, properdin | 3.2 |
| 453775 | NM_002916 | Hs.35120 | replication factor C (activator 1) 4 (37 kD) | 3.2 |
| 408418 | AW963897 | Hs. 44743 | KIAA1435 protein | 3.2 |
| 442025 | AW887434 | Hs. 11810 | ESTs, Weakly similar to CD4 [*C. elegans*] | 3.2 |
| 417006 | AW673606 | Hs. 80758 | aspartyl-tRNA synthetase | 3.2 |
| 407881 | AW072003 | Hs. 40968 | heparan sulfate (glucosamine) 3-O-solfotransf | 3.2 |
| 444755 | AA431791 | Hs. 183001 | ESTs | 3.2 |
| 402829 | | | 0 | 3.2 |
| 451593 | AF151879 | Hs. 26706 | CGI-121 protein | 3.2 |
| 419926 | AW900992 | Hs. 93796 | DKFZP586D2223 protein | 3.2 |
| 434551 | BE387162 | Hs.280858 | ESTs, Highly similar to XPB_HUMAN DNA-REPAIR | 3.2 |
| 445929 | AI089660 | Hs. 7838 | makorin, ring finger protein, 1 | 3.2 |
| 409365 | AA702376 | Hs. 226440 | *Homo sapiens* clone 24881 mRNA sequence | 3.2 |
| 418836 | AI655499 | Hs. 61712 | ESTs | 3.2 |
| 441020 | W79283 | Hs. 35962 | ESTs | 3.1 |
| 422363 | T55979 | Hs. 115474 | replication factor C (activator 1) 3 (38 kD) | 3.1 |
| 413010 | AA393273 | Hs.75133 | transcription factor 6-like 1 (mitochondrial | 3.1 |
| 452092 | BE245374 | Hs.27842 | hypothetical protein FLJ11210 | 3.1 |
| 410486 | AW235094 | Hs.193424 | ESTs, Weakly similar to KIAA1064 protein [H.s | 3.1 |
| 434540 | NM_016045 | Hs. 5184 | TH1 drosophila homolog | 3.1 |
| 409178 | BE393948 | Hs.50915 | kallikrein 5 | 3.1 |
| 439480 | AL038511 | Hs. 125316 | ESTs | 3.1 |
| 417848 | AA206581 | Hs. 39457 | ESTs | 3.1 |
| 446293 | AI420213 | Hs. 149722 | ESTs | 3.1 |
| 408108 | AI580492 | Hs. 42743 | hypothetical protein | 3.1 |
| 415947 | U04045 | Hs. 78934 | mutS (E coli) homolog 2 (colon cancer, nonpo | 3.1 |
| 410519 | AW612264 | Hs.131705 | ESTs | 3.1 |
| 421987 | AI133161 | Hs. 286131 | CGI-101 protein | 3.1 |
| 440046 | AW402306 | Hs. 6877 | hypothetical protein FLJ10483 | 3.1 |
| 453931 | AL121278 | Hs. 25144 | ESTs | 3.1 |
| 454423 | AW603985 | Hs. 179662 | nucleosome assembly protein 1-like 1 | 3.1 |
| 459089 | F13036 | Hs. 27373 | *Homo sapiens* mRNA; cDNA DKFZp564O1763 (from c | 3.1 |
| 418735 | N48769 | Hs. 44609 | ESTs | 3.1 |
| 414245 | BE148072 | Hs. 75850 | WAS protein family, member 1 | 3.1 |
| 410909 | AW898161 | Hs.53112 | ESTs, Weakly similar to ALU8_HUMAN ALU SUBFAM | 3.1 |
| 434926 | BE543269 | Hs. 50252 | *Homo sapiens* HSPC283 mRNA, partial cds | 3.1 |
| 409239 | AA740875 | Hs. 44307 | ESTs | 3.1 |
| 429017 | AA463605 | Hs. 238995 | ESTs | 3.1 |
| 447072 | D61594 | Hs.17279 | tyrosylprotein sulfotransferase 1 | 3.1 |
| 426514 | BE616633 | Hs. 301122 | bone morphogenetic protein 7 (osteogenic prot | 3.1 |
| 448133 | AA723157 | Hs. 73769 | folate receptor 1 (adult) | 3.1 |
| 418792 | AB037805 | Hs.88442 | KIAA1384 protein | 3.1 |
| 427528 | AU077143 | Hs. 179565 | minichromosome maintenance deficient (S.cere | 3.1 |
| 402077 | | | 0 | 3.1 |
| 440671 | AW297920 | Hs. 130054 | ESTs | 3.1 |
| 419890 | X17360 | Hs. 278255 | homeo box D4 | 3.1 |
| 406687 | M31126 | Hs. 272620 | pregnancy specific beta-1-glycoprotein 9 | 3.1 |
| 409151 | AA306105 | Hs.50785 | SEC22, vesicle trafficking protein (S.cerevi | 3.1 |
| 431221 | AA449015 | Hs.286145 | SRB7 (suppressor of RNA polymerase B, yeast) | 3.1 |
| 443584 | AI807036 | Hs. 101619 | ESTs | 3.1 |
| 445525 | BE149866 | Hs. 14831 | ESTs | 3.1 |
| 410441 | BE298210 | | gb: 601118016F1 NIH_MGC_17 *Homo sapiens* cDNA c | 3.1 |
| 422634 | NM_016010 | Hs.118821 | CGI-62 protein | 3.0 |
| 420022 | AA256253 | Hs. 120817 | ESTs | 3.0 |
| 453912 | AL121031 | Hs. 32556 | KIAA0379 protein | 3.0 |
| 456844 | AI264155 | Hs.152981 | CDP-diacylglycerol synthase (phosphatidate cy | 3.0 |
| 414941 | C14865 | Hs. 182159 | ESTs | 3.0 |
| 407807 | AL031427 | Hs. 40094 | Human DNA sequence from clone 167A19 on chrom | 3.0 |
| 414725 | AA769791 | Hs.120355 | *Homo sapiens* cDNA FLJ13148 fis, clone NT2RP30 | 3.0 |
| 444420 | AI148157 | Hs. 146766 | ESTs | 3.0 |
| 431742 | NM_016652 | Hs. 268281 | CGI-201 protein | 3.0 |
| 412519 | AA196241 | Hs. 73980 | troponin T1, skeletal, slow | 3.0 |
| 418348 | AI537167 | Hs. 96322 | *Homo sapiens* cDNA FLJ23560 fis, clone LNG098 | 3.0 |
| 444261 | AA298958 | Hs.10724 | MD5023 protein | 3.0 |
| 457465 | AW301344 | Hs. 195969 | ESTs | 3.0 |
| 443933 | AI091631 | Hs. 135501 | *Homo sapiens* two pore potassium channel KT3 3 | 3.0 |
| 442150 | AI368158 | Hs.128864 | ESTs | 3.0 |
| 414883 | AA926960 | Hs.77550 | CDC28 protein kinase 1 | 3.0 |
| 442879 | AF032922 | Hs. 8813 | syntaxin binding protein 3 | 3.0 |
| 437949 | U78519 | Hs. 41654 | ESTs | 3.0 |

TABLE 10A-continued

ABOUT 733 UP-REGULATED GENES, OVARIAN CANCER VERSUS NORMAL ADULT TISSUES

| Pkey | Ex Accn | UG ID | Title | ratio |
|---|---|---|---|---|
| 403515 | | | 0 | 3.0 |
| 403864 | | | 0 | 3.0 |
| 407785 | AW207285 | Hs. 98279 | ESTs | 3.0 |
| 426199 | AA371865 | Hs. 97090 | ESTs | 3.0 |
| 426324 | AW291787 | Hs. 200933 | ESTs | 3.0 |
| 427738 | NM_000318 | Hs.180612 | peroxisomal membrane protein 3 (35 kD, Zellweg | 3.0 |
| 427837 | U87309 | Hs. 180941 | vacuolar protein sorting 41 (yeast homolog) | 3.0 |
| 439430 | AF124250 | Hs. 6564 | breast cancer anti-estrogen resistance 3 | 3.0 |
| 442039 | AW276240 | Hs.128352 | ESTs, Weakly similar to p80 [*R.norvegicus*] | 3.0 |
| 446978 | NM_001938 | Hs. 16697 | down-regulator of transcription 1, TBP-bindin | 3.0 |
| 452431 | U88879 | Hs. 29499 | toll-like receptor 3 | 3.0 |
| 452841 | T17431 | Hs. 65412 | DEAD/H (Asp-Gla-Ata-Asp/His) box polypeptide | 3.0 |
| 432114 | AL036021 | Hs. 225597 | ESTs | 3.0 |
| 445640 | AW969626 | Hs.31704 | ESTs, Weakly similar to KIAA0227 [*H. sapiens*] | 3.0 |
| 442607 | AA507576 | Hs. 288361 | KIAA0741 gene product | 3.0 |
| 453920 | AI133148 | Hs. 36602 | I factor (complement) | 3.0 |
| 430000 | AW205931 | Hs.99598 | ESTs | 3.0 |
| 429164 | AI688663 | Hs.116586 | ESTs | 3.0 |
| 453331 | AI240665 | Hs. 8895 | ESTs | 3.0 |
| 448663 | BE614599 | Hs. 108823 | *H. sapiens* gene from PAC 42616, similar to syn | 3.0 |
| 425776 | U25128 | Hs. 159499 | parathyroid hormone receptor 2 | 3.0 |
| 401714 | | | 0 | 3.0 |
| 400903 | | | 0 | 3.0 |
| 428428 | AL037544 | Hs. 184298 | cyclin-dependent kinase 7 (homolog of Xenopus | 3.0 |
| 443761 | AI525743 | Hs. 160603 | ESTs | 3.0 |
| 451640 | AA195601 | Hs. 26771 | Human DNA sequence from close 747H23 on chrom | 3.0 |
| 442580 | AI733682 | Hs. 130239 | ESTs | 3.0 |

Pkey: Primekey
Es Accn: Exemplar Accession
UG ID: UniGene ID
Title: UniGene title
ration: ratio tumor vs normal tissues

TABLE 10B

| Pkey | CAT Number | Accession |
|---|---|---|
| 407596 | 1003489_1 | R86913 R86901 H25352 R01370 H43764 AW044451 W21298 |
| 409763 | 115392_1 | AL043212 AA077575 AA077655 R19502 BE545457 AI638421 R14093 |
| 410360 | 1197225_-2 | AW663690 |
| 410441 | 120358_1 | BE298210 AI672315 AW086489 BE298417 AA455921 AA902537 BE327124 R14963 AA085210 AW274273 AI333584 AI369742 AI039658 AI885095 AI476470 AI287650 AI885299 AI985381 AW592624 AW340136 AI266556 AA456390 AI310815 AA484951 |
| 411560 | 1249443_1 | AW851186 AW996967 BE143456 |
| 414315 | 143512_1 | Z24878 AA494098 F13654 AA494040 AA143127 |
| 418417 | 1750818_1 | R77182 R77197 R80484 |
| 418454 | 175699_1 | AA315308 AA223392 BE538098 BE087173 |
| 419346 | 184129_1 | AI830417 AA236612 |
| 424770 | 243504_1 | AA425562 AI880208 AA346646 N22655 AW811775 AW811786 |
| 427943 | 284802_1 | AW959075 W06838 AA417863 |
| 431965 | 33959_2 | BE175190 BE003348 |
| 436812 | 427323_1 | AW298067 AA731645 AA810101 AW194180 AI690673 AW978773 |
| 437938 | 44573_2 | AI950087 N70208 R97040 N36809 AI308119 AW967677 N35320 AI251473 H59397 AW971573 R97278 W01059 AW967671 AA908598 AA251875 AI820501 AI820532 W87891 T85904 U71456 T82391 BE328571 T75102 R34725 AA884922 BE328517 AI219788 AA884444 N92578 F13493 AA927794 AI560251 AW874068 AL134043 AW235363 AA663345 AW008282 AA488964 AA283144 AI890387 AI950344 AI741346 AI689062 AA282915 AW102898 AI872193 AI763273 AW173586 AW150329 AI653832 AI762688 AA988777 AA488892 AI356394 AW103813 AI539642 AA642789 AA856975 AW505512 AI961530 AW629970 BE612881 AW276997 AW513601 AW512843 AA044209 AW856538 AA180009 AA337499 AW961101 AA251669 AA251874 AI819225 AW205862 AI683338 AI858509 AW276905 AI633006 AA972584 AA908741 AW072629 AW513996 AA293273 AA969759 N75628 N22388 H84729 H60052 T92487 AI022058 AA780419 AA551005 W80701 AW613456 AI373032 AI564269 F00531 H83488 W37181 W78802 R66056 AI002839 R67840 AA300207 AW959581 T63226 F04005 |
| 439255 | 470321_1 | BE164500 AA832198 BE164502 |
| 447385 | 719912_1 | F12863 AI377223 T75099 |
| 454193 | 1050256_1 | BE141183 AW178167 AW178162 AW178166 AW178172 AW845893 AW178159 AW178222 AW178213 AW178215 AW178090 AW178091 AW178161 AW178207 AW178210 AW178214 AW178212 BE140918 BE140917 AW178135 AW178205 AW178209 AW178223 AW178220 AW178206 AW178203 AW178165 AW178168 AW178160 AW178136 AW845878 AW178131 AW178138 AW178105 AW845894 AW178129 AW845810 AW845828 AW178216 AW178112 AW178211 AW178224 BE140915 AW178221 AW178130 AW178134 AW178096 AW178108 |

TABLE 10B-continued

| Pkey | CAT Number | Accession |
|---|---|---|
| | | AW178133 AW178164 AW178218 AW178171 AW178157 AW178158 AW178103 BE141189 AW178170 AW845816 BE141586 AW178156 AW178104 AW178163 AW178093 AW178208 AW178137 AW178140 AW178219 BE141592 AW845901 BE141580 AW178155 BE141598 BE140957 |
| 454556 | 1223878_1 | AW807073 AW807055 AW807067 AW807276 AW807030 AW807363 AW845892 AW807091 AW807275 AW807284 AW807287 AW845891 AW807195 AW807271 |
| 454933 | 1245515_1 | BE141714 AW845993 AW845989 |

Pkey: Unique Eos probeset identifier number
CAT number: Gene cluster number
Accession: Genbank accession numbers

TABLE 10C

| Pkey | Ref | Strand | Nt_position |
|---|---|---|---|
| 400534 | 6981826 | Minus | 278637–279292 |
| 400666 | 8118496 | Plus | 17982–18115, 20297–20456 |
| 400903 | 2911732 | Plus | 59112–59228 |
| 401197 | 9719705 | Plus | 176341–176452 |
| 401480 | 7321503 | Plus | 166120–166347, 166451–166557, 169651–169832 |
| 401508 | 7534110 | Minus | 110779–110983 |
| 401517 | 7677912 | Plus | 29278–29770 |
| 401644 | 8576138 | Plus | 82655–83959 |
| 401714 | 6715702 | Plus | 96484–96681 |
| 402077 | 8117414 | Plus | 65014–65195 |
| 402222 | 9958106 | Plus | 3261–3834, 3939–4269 |
| 402408 | 9796239 | Minus | 110326–110491 |
| 402820 | 6456853 | Minus | 82274–82443 |
| 402829 | 8918414 | Plus | 101532–101852, 102006–102263 |
| 403381 | 9438267 | Minus | 26009–26178 |
| 403515 | 7656757 | Minus | 173358–179553 |
| 403729 | 7543752 | Minus | 37662–37909 |
| 403864 | 7709019 | Minus | 51753–51890, 79290–79445 |
| 404108 | 8247074 | Minus | 63603–64942 |
| 404232 | 8218045 | Minus | 71800–71956 |
| 404552 | 7243881 | Plus | 19854–20010 |
| 404567 | 7249169 | Minus | 101320–101501 |
| 404599 | 8705107 | Plus | 110443–110733 |
| 404915 | 7341766 | Minus | 100915–101087 |
| 404996 | 6007890 | Plus | 37999–38145, 38652–38998, 39727–39872, 40557–40674, 42351–42450 |
| 405095 | 8072599 | Plus | 138877–139066 |
| 406069 | 9117732 | Plus | 68880–69374 |
| 406117 | 9142932 | Plus | 54304–54584 |

Pkey: Unique number corresponding to an Eos probeset
Ref: Sequence source The 7 digit numbers in this column are Genbank Identifier (GI) numbers "Dunham I et al." refers to the publication entitled "The DNA sequence of human chromosome 22" Dunham, et al. (1999) Nature 402: 489–495
Strand: Indicates DNA strand from which exons were predicted
Nt_position: Indicates nucleotide positions of predicted exons Table 11A lists about 222 genes up-regulated in ovarian cancer compared to normal adult tissues that are likely to encode extracellular or cell-surface proteins. These were selected as for Table 10A, except that the ratio was greater than or equal to 2.0, and the predicted protein contained a structural domain that is indicative of extracellular localization (e.g. ig, fn3, egf, 7tm domains, signal sequences, transmembrane domains). Predicted protein domains are noted.

TABLE 11A

ABOUT 222 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 400292 | AA250737 | Hs. 72472 | BMPR-lb, bone morphogenetic pro | pkinase, Activin_recp | 30.0 |
| 400289 | X07820 | Hs. 2258 | Matrix Metalloproteinase 10 (Strom | SS, hemepexin, Peptidas | 25.2 |
| 427585 | D31152 | Hs. 179729 | collagen, type X, alpha 1 (Schmid m | C1q, Collagen | 22.7 |
| 436982 | AB018305 | Hs. 5378 | spondin 1, (f-spondin) extracellular m | tsp_1 | 19.0 |
| 428579 | NM_005756 | Hs. 184942 | G protein-coupled receptor 64 | TM | 17.4 |
| 443646 | AI085198 | Hs. 298699 | ESTs | TSPN, vwc, tsp_1, EGF | 15.1 |
| 436209 | AW850417 | Hs. 254020 | ESTs, Moderately similar to unname | TM | 14.1 |

TABLE 11A-continued

ABOUT 222 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 418601 | AA279490 | Hs. 86368 | calmegin | SS, calreticulin | 13.8 |
| 428532 | AF157326 | Hs. 184786 | TBP-interacting protein | TM | 13.6 |
| 427344 | NM_000869 | Hs. 2142 | 5-hydroxytryptamine (serotonin) rec | TM, neur_chan | 11.8 |
| 432677 | NM_004482 | Hs. 278611 | UDP-N-acetyl-alpha-D-galactosamin | TM, Glycos_transf_2, Ri | 11.0 |
| 404567 | NM_015902 | Hs. 278428 | progestin induced protein (DD5) | TM, HECT, zf-UBR1 | 10.8 |
| 445537 | AJ245671 | Hs. 12844 | EGF-like-domain, multiple 6 | SS, MAM, EGF | 8.9 |
| 409928 | AL137163 | Hs. 57549 | hypothetical protein dJ473B4 | TM, MSP_domain | 8.8 |
| 407001 | U12471 | Hs. 247954 | Human thrombospondin-1 gene, par | TSPN, vwc, tsp_1, EGF | 8.5 |
| 453370 | AI470523 | Hs. 182356 | ESTs, Moderately similar to translat | ABC_tran, ABC_membr | 8.4 |
| 400298 | AA032279 | Hs. 61635 | STEAP1 | TM | 8.1 |
| 431725 | X65724 | Hs. 2839 | Norrie disease (pseudoglioma) | SS, Cys_knot | 7.9 |
| 429609 | AF002246 | Hs. 210863 | cell adhesion molecule with homolo | TM, fn3, ig | 7.8 |
| 412170 | D16532 | Hs. 73729 | very low density lipoprotein recepto | TM, ldl_recept_a, ldl_rec | 7.4 |
| 428954 | AF100781 | Hs. 194678 | WNT1 inducible signaling pathway | SS, IGFBP, Cys_knot, tsp | 7.4 |
| 418007 | M13509 | Hs. 83169 | Matrix metalloprotease 1 (interstitia | SS, hemopexin, Peptidas | 7.2 |
| 424001 | W67883 | Hs. 137476 | KIAA1051 protein | Pep_M128_propep, Rep | 7.2 |
| 456965 | AW131888 | Hs. 172792 | ESTs, Weakly similar to hypothetica | TM | 7.1 |
| 446142 | AI754693 | Hs. 145968 | ESTs | Cadherin_C_term, cadhe | 7.0 |
| 415138 | C18356 | Hs. 78045 | tissue factor pathway inhibitor 2 TFP | Kunitz_BPTI, G-gamma | 6.8 |
| 438167 | R28363 | Hs. 24286 | ESTs | 7tm_1 | 6.6 |
| 452097 | AB002364 | Hs. 27916 | ADAM-TS3, a disintegrin-like and | Pep_M12B_propep, Rep | 6.4 |
| 449048 | Z45051 | Hs. 22920 | similar to S68401 (cattle) glucose in | SS | 5.8 |
| 425371 | D49441 | Hs. 155981 | mesothelin | SS | 5.7 |
| 407945 | X69208 | Hs. 606 | ATPase, Cu++ transporting, alpha p | TM, E1-E2_ATPase, Hy | 5.6 |
| 424620 | AA101043 | Hs. 151254 | kallikrein 7 (chymotryptic, stratum c | SS, trypsin | 5.5 |
| 420362 | U79734 | Hs. 97206 | huntingtin interacting protein 1 | TM, ENTH, I_LWEQ | 5.4 |
| 413384 | NM_000401 | Hs. 75334 | exoatoses (multiple) 2 | TM | 5.3 |
| 425154 | NM_001851 | Hs. 154850 | collagen, type IX, alpha 1 | Collagen, TSPN | 5.2 |
| 411945 | AL033527 | Hs. 92137 | v-myc avian myelocytomatosis viral | TGF-beta, TGFb_propep | 5.1 |
| 415539 | AI733881 | Hs. 72472 | BMPR-lb, bone morphogenetic pro | pkinase, Activin_recp | 5.1 |
| 438018 | AK001160 | Hs. 5999 | hypothetical protein FLJ10298 | TM | 4.9 |
| 424539 | L02911 | Hs. 150402 | activin A receptor, type I | Activin_recp, pkinase | 4.8 |
| 450375 | AA009647 | Hs. 8850 | a disintegrin and metalloproteinase d | disintegrin, Reprolysin, P | 4.7 |
| 451684 | AF216751 | Hs. 26813 | CDA14 | TM | 4.6 |
| 400296 | AA305627 | Hs. 139336 | ATP-binding cassette, sub-family C | TM, ABC_tran ABC_m | 4.6 |
| 429597 | NM_003816 | Hs. 2442 | a disintegrin and metalloproteinase d | TM | 4.5 |
| 400534 | AP000541 | | predicted exons | TM, KRAB, zf-C2H2 | 4.5 |
| 425506 | NM_003666 | Hs. 158205 | basic leucine zipper nuclear factor 1 | TM, Folate_carrier | 4.5 |
| 413472 | BE242870 | Hs. 75379 | solute carrier family 1 (glial high aff | TM, SDF | 4.4 |
| 449535 | W15267 | Hs. 23672 | low density lipoprotein receptor-rela | SS, ldl_recept_b, dl_rece | 4.4 |
| 452028 | AK001859 | Hs. 27595 | hypothetical protein FLJ10997 | Zn_carbOpept, Propep_M | 4.3 |
| 418693 | AI750878 | Hs. 87409 | thrombospondin 1 | EGF, TSPN, tsp_1, tsp_3, | 4.3 |
| 410361 | BE391804 | Hs. 62661 | guanylate binding protein 1, interfer | TM, GBP | 4.2 |
| 407872 | AB039723 | Hs. 40735 | frizzled (Drosophila) homolog 3 | Frizzled, Fz, 7tm_2 | 4.2 |
| 421502 | AF111856 | Hs. 105039 | solute carrier family 34 (sodium pho | TM, Na_Pi_cotrans | 4.2 |
| 412494 | AL133900 | Hs. 792 | ADP_ribosylation factor domain pro | arf, zf-B_box, zf-C3HC4 | 4.0 |
| 405095 | NM_014479 | Hs. 145296 | disintegrin protease | Reprolysin, disintegrin | 4.0 |
| 431130 | NM_006103 | Hs. 2719 | epididymis-specific, whey-acidic pro | SS, wap | 4.0 |
| 407792 | AI077715 | Hs. 39384 | putative secreted ligand homologons | SS | 4.0 |
| 408829 | NM_006042 | Hs. 48384 | heparan sulfate (glucosamine) 3-O-s | TM | 3.8 |
| 450581 | AF081513 | Hs. 25195 | endometrial bleeding associated fact | SS, TGF-beta, TGFb_pro | 3.7 |
| 432712 | AB016247 | Hs. 288031 | sterol-C5-desaturase (fungal ERG3, | TM, Sterol_desat | 3.7 |
| 450447 | AF212223 | Hs. 25010 | hypothetical protein P15-2 | TM, ANF_receptor, guan | 3.6 |
| 414706 | AW340125 | Hs. 76989 | KIAA0097 gene product | TM | 3.6 |
| 417389 | BE260964 | Hs. 82045 | Midkine (neurite growth-promoting | TM, PTN_MK | 3.6 |
| 400666 | X07820 | Hs. 2258 | Matrix Metalloproteinase 10 (Strom | SS, hemopexin, Peptidas | 3.5 |
| 406400 | AA343629 | Hs. 104570 | kallikrein 8 (neuropsin/ovasin) | SS, trypsin | 3.4 |
| 407864 | AF069291 | Hs. 40539 | chromosome 8 open reading frame 1 | TM, FHA, BRCT | 3.4 |
| 452822 | XB5689 | Hs. 288617 | Homo sapiens cDNA. FLJ2621 fis, | EGF, fn3, pkinase | 3.4 |
| 446913 | AA430650 | Hs. 16529 | transmembrane 4 superfamily memb | TM, transmembrane4 | 3.4 |
| 422611 | AA158177 | Hs. 118722 | fucosyltransferase 8 (alpha.(1,6) fuc | SS | 3.4 |
| 423161 | AL049227 | Hs. 124776 | Homo sapiens mRNA, cDNA DKFZ | cadherin, Cadherin_C_te | 3.3 |
| 435102 | AW899053 | Hs. 76917 | F-box only protein 8 | TM, Sec7 | 3.3 |
| 416530 | U62801 | Hs. 79361 | kallikrein 6 (nenrosin, zyme) | SS, TM, trypsin | 3.3 |
| 401197 | | | predicted exons | arf, Ets | 3.3 |
| 436525 | AA721428 | Hs. 26145 | Homo sapiens cDNA FLJ14127 fis, | TM | 3.2 |
| 452943 | BE247449 | Hs. 31082 | hypothetical protein FLJ10525 | TM | 3.2 |
| 411393 | AW797437 | Hs. 69771 | B-factor, properdin | SS, sushi, trypsin, vwa, fib | 3.2 |
| 407881 | AW072003 | Hs. 40968 | heparan sulfate (glucosamine) 3-O-s | SS | 3.2 |
| 418836 | AI655499 | Hs. 161712 | ESTs | pkinase, Activin_recp | 3.2 |
| 409178 | BE393948 | Hs. 50915 | kallikrein | SS, trypsin | 3.1 |
| 421987 | AI133161 | Hs. 286131 | CGI-101 protein | TM | 3.1 |

TABLE 11A-continued

ABOUT 222 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 447072 | D61594 | Hs. 17279 | tyrosylprotein sulfotransferase 1 | SS | 3.1 |
| 426514 | BE616633 | Hs. 301122 | bone morphogenetic protein 7 (osteo | SS, TGFb_propeptide, T | 3.1 |
| 448133 | AA723157 | Hs. 73769 | folate receptor 1 (adult) | TM | 3.1 |
| 406687 | M31126 | Hs. 272620 | pregnancy specitic beta-1-glycoprot | SS, Peptidase_M10, hem | 3.1 |
| 456844 | AI264155 | Hs. 152981 | CDP-diacylglycerol synthase (phosp | TM, Cyhdylyltrans | 3.0 |
| 414725 | AA769791 | Hs. 120355 | Homo sapiens cDNA FLJ13148 fis, | SPRY, 7tm_1 | 3.0 |
| 407785 | AW207285 | Hs. 98279 | ESTs | Sema, ig | 3.0 |
| 427738 | NM_000318 | Hs. 180612 | peroxisomal membrane protein 3 (35 | TM, zf-C3HC4 | 3.0 |
| 452431 | U88879 | Hs. 29499 | toll-like receptor 3 | TM, TIR, LRRCT | 3.0 |
| 453920 | AI133148 | Hs. 36602 | I factor (complement) | ldl_recept_a, trypsin, SRC | 3.0 |
| 453331 | AI240665 | Hs. 8895 | ESTs | disintegrin, Reprolysin, P | 3.0 |
| 425776 | U25128 | Hs. 159499 | parathyroid hormone receptor 2 | TM, 7tm_2 | 3.0 |
| 428428 | AL037544 | Hs. 184298 | cyclin-dependent kinase 7 (homolog | TM, pkinase | 3.0 |
| 407910 | AA650274 | Hs. 41296 | fibronectin leucine rich transmembra | TM, LRRCT, LRRNT, LR | 2.9 |
| 408380 | AF123050 | Hs. 44532 | diubiquitin | TM, ubiquitin, 7tm_3, AN | 2.9 |
| 407783 | AW996872 | Hs. 172028 | a disintegrin and metalloproteinase d | disintegrin, Reprolysin | 2.9 |
| 420757 | X78592 | Hs. 99915 | androgen receptor (dihydrotestostero | TM, Androgen_recep, ho | 2.9 |
| 424406 | D54120 | Hs. 146409 | wingless-type MMTV integration sit | cadherin, Cadherin_C_te | 2.9 |
| 428549 | AA430064 | Hs. 220929 | ESTs, Moderately similar to ARF-fa | arf | 2.9 |
| 419452 | U33635 | Hs. 90572 | PTK7 protein tyrosine kinase 7 | TM, pkinase, ig | 2.9 |
| 452281 | T93500 | Hs. 28792 | ESTs | TGFb_propeptide, TGF- | 2.9 |
| 420440 | NM_002407 | Hs. 97644 | mammaglobin 2 | SS, Uteroglobin | 2.9 |
| 418848 | AI820961 | Hs. 193465 | ESTs | pkinase, Activin_recp | 2.9 |
| 421991 | NM_014918 | Hs. 110488 | KIAA0990 protein | SS | 2.9 |
| 433190 | M26901 | Hs. 3210 | renin | SS, asp | 2.9 |
| 424538 | NM_005095 | Hs. 150390 | zinc finger protein 262 | TM | 2.8 |
| 433002 | AF048730 | Hs. 279906 | cyclin T1 | SS | 2.8 |
| 444342 | NM_014398 | Hs. 10887 | similar to lysosome-associated mem | TM, Lamp | 2.8 |
| 430598 | AK001764 | Hs. 247112 | hypothetical protein FLJ10902 | TM | 2.8 |
| 428450 | NM_014791 | Hs. 184339 | KIAA0175 gene product | TM, pkinase, KA1 | 2.8 |
| 450171 | AL133661 | Hs. 24583 | hypothetical protein DKFZp434C03 | TM | 2.8 |
| 423554 | M90516 | Hs. 1674 | glutamine-fructose-6-phosphate tran | TM, GATase 2, SIS | 2.8 |
| 430016 | NM_004736 | Hs. 227656 | xenotropic and polytropic retrovirus | TM | 2.8 |
| 417866 | AW067903 | Hs. 82772 | collagen, type XI, alpha 1 | Collagen, COLF1, TSPN | 2.8 |
| 424894 | H83520 | Hs. 153678 | reproduction 8 | SS, UBX | 2.8 |
| 430651 | AA961694 | Hs. 105187 | kinesin protein 9 gene | SS | 2.7 |
| 414853 | U31116 | Hs. 77501 | sarcoglycan, beta (43kD dystrophin- | TM | 2.7 |
| 448595 | AB014544 | Hs. 21572 | KIAA0644 gene product | TM, LRRCT, LRR | 2.7 |
| 452835 | AK001269 | Hs. 30738 | ESTs | TM | 2.7 |
| 403019 | AA834626 | Hs. 66718 | RAD54 (S. cerevisiae)-like | SS, Anti_proliferat | 2.7 |
| 420281 | AI623693 | Hs. 191533 | ESTs | Cation_efflux | 2.7 |
| 434815 | AF155582 | Hs. 46744 | core 1 UDP-galactose N-acetylgalact | SS | 2.6 |
| 432201 | AI538613 | Hs. 135657 | TMPRSS3a mRNA for serine protea | trefoil, trypsin | 2.6 |
| 430450 | R23553 | Hs. 241489 | hypothetical protein | SS | 2.6 |
| 448402 | BE244226 | Hs. 21094 | RAB18, member RAS oncogene fam | ras, arf | 2.6 |
| 421802 | BE261458 | Hs. 108408 | CGI-78 protein | TM | 2.6 |
| 452355 | N54926 | Hs. 29202 | G protein-coupled receptor 34 | TM, 7tm_1 | 2.6 |
| 417742 | R64719 | | gb: EST22d11 WATM1 Homo sapie | ank, deatti, RHD, TIG | 2.6 |
| 451346 | NM_006338 | Hs. 26312 | glioma amplified on chromosome 1 | TM, ig, LRR, LRRNT, LR | 2.6 |
| 433147 | AF091434 | Hs. 43080 | platelet derived growth factor C | TM, PDGF, CUB | 2.6 |
| 420079 | NM_014051 | Hs. 94896 | PTD011 protein | SS, TM, | 2.6 |
| 419918 | X80700 | Hs. 93728 | pre-B-cell leukemia transcription fac | homeobox, ig, Acyltransf | 2.5 |
| 432350 | NM_005865 | Hs. 274407 | protease, serine, 16 (thymus) | SS | 2.5 |
| 406671 | AA129547 | Hs. 285754 | met proto-oncogene (hepatocyte gro | pkinase, Sema, Plexin_re | 2.5 |
| 417412 | X16896 | Hs. 82112 | interleukin 1 receptor, type I | SS, TIR, ig | 2.5 |
| 422530 | AW972300 | Hs. 118110 | bone marrow stromal cell antigen 2 | TM | 2.5 |
| 433929 | AI375499 | Hs. 27379 | ESTs | EGF, ldl_recept_a, ldl_re | 2.5 |
| 443562 | AF118838 | Hs. 9599 | solute carrier family 25, member 13 | TM, mito_carr | 2.5 |
| 414386 | X00442 | Hs. 75990 | haptoglobin | sushi, trypsin | 2.5 |
| 417576 | AA339449 | Hs. 82285 | phosphoribosylglycinamide fomyltr | AIRS, formyl_transf, GA | 2.5 |
| 449207 | AL044222 | Hs. 23255 | nucleoporin 155kD | TM | 2.5 |
| 416107 | AA173846 | Hs. 79015 | antigen identified by monoclonal ant | TM, ig | 2.4 |
| 421750 | AK000768 | Hs. 107872 | hypothetical protein FLJ20761 | TM, PH | 2.4 |
| 414812 | X72755 | Hs. 77367 | monokine induced by gamma interfe | SS, IL8 | 2.4 |
| 406137 | R42764 | Hs. 3248 | mutS (E. coli) homolog 6 | TM MutS_C, MutS_N, P | 2.4 |
| 450710 | AW953381 | Hs. 18627 | ESTs, Weakly similar to G01447 GP | TM | 2.4 |
| 430291 | AV660345 | Hs. 238126 | CGI-49 protein | TM | 2.4 |
| 425184 | BE278288 | Hs. 155048 | Lutheran blood group (Auberger b a | ig | 2.4 |
| 451418 | BE387790 | Hs. 26369 | ESTs | TM | 2.4 |
| 412277 | BE277592 | Hs. 73799 | guanine nucleotide binding protein ( | TM, G-alpha | 2.4 |
| 413719 | BE439580 | Hs. 75498 | small inducible cytokine subfamily A | SS, IL8 | 2.4 |

TABLE 11A-continued

ABOUT 222 UP-REGULATED GENES ENCODING EXTRACELLULAR/CELL
SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 451806 | NM_003729 | Hs. 27076 | RNA 3'-terminal phosphate cyclase | TM, RCT | 2.3 |
| 416224 | NM_002902 | Hs. 79088 | reticulocalbin 2, EF-hand calcium br | SS, efhand | 2.3 |
| 452268 | NM_003512 | Hs. 28777 | H2A histone family, member L | histone, Calc_CGRP_IA4 | 2.3 |
| 451668 | Z43948 | Hs. 26789 | ASPIC (acidic secreted protein in ca | SS, TM, | 2.3 |
| 400880 | M84349 | Hs. 119663 | CD59 antigen | SS, UPAR_LY6 | 2.3 |
| 421340 | F07783 | Hs. 1369 | decay accelerating factor for comple | SS, sushi | 2.3 |
| 443986 | AI381750 | Hs. 283437 | HTGN29 protein | TM | 2.3 |
| 443037 | AW500305 | Hs. 8906 | syntaxin 7 | TM, Syntaxin | 2.3 |
| 440516 | S42303 | Hs. 161 | cadherin 2, type 1, N-cadherin (neur | HNH, cadherin, Cadherin | 2.3 |
| 404877 | AI394145 | Hs. 18048 | melanoma antigen MAGE-10 | TM, MAGE | 2.3 |
| 440704 | M69241 | Hs. 162 | insulin-like growth factor binding pr | SS, thyroglobulin_1, IGF | 2.3 |
| 437952 | D63209 | Hs. 5944 | solute carrier family 11 (proton-coup | TM | 2.3 |
| 418624 | AI734080 | Hs. 104211 | ESTs | Sema, ig | 2.2 |
| 410434 | AF051152 | Hs. 63668 | toll-like receptor 2 | SS, TIR, LRRCT, LRR | 2.2 |
| 424687 | J05070 | Hs. 151738 | matrix metalloproteinase 9 (gelatina | SS, fn2, hemopexin, Pepti | 2.2 |
| 431457 | NM_012211 | Hs. 256297 | integrin, alpha 11 | TM, FG-GAP, vwa | 2.2 |
| 407907 | AI752235 | Hs. 41270 | procollagen-lysine, 2-oxoglutarate 5 | SS, Lyayl_hydro | 2.2 |
| 400898 | AF220030 | Hs. 125300 | *Homo sapiens* tripartite motif conta | SPRY, 7tm_1 | 2.2 |
| 400303 | AA242758 | Hs. 79136 | Human breast cancer, estrogen regul | SS, TM, | 2.2 |
| 411789 | AF245505 | Hs. 72157 | *Homo sapiens* mRNA: cDNA DKFZ | ig, LRRCT | 2.2 |
| 414809 | AI434699 | Hs. 77356 | transferrin receptor (p90, CD71) | TM, PA, Ribosomal_S2 | 2.2 |
| 401131 | NM_001651 | Hs. 298023 | *Homo sapiens* aquaponn 5 (AQP5), | TM, MIP | 2.2 |
| 400277 | Y00281 | Hs. 2280 | Human mRNA for nbophorin I | TM | 2.1 |
| 409317 | U20165 | Hs. 53250 | bone morphogenetic protein recepto | TM, pkinase | 2.1 |
| 409956 | AW103364 | Hs. 727 | H sapiens activin beta-A subunit (ex | TGP-beta, TGFb_propep | 2.1 |
| 451253 | H48299 | Hs. 26126 | claudin 10 | TM, PMP22_Claudin | 2.1 |
| 429638 | AI916662 | Hs. 211577 | Kinectin 1 (kinesin receptor) | TM | 2.1 |
| 409267 | NM_012453 | Hs. 52515 | transducin (beta)-like 2 | TM, WD40 | 2.1 |
| 418414 | J04977 | Hs. 84981 | X-ray repair complementing defectiv | SS | 2.1 |
| 449057 | AB037784 | Hs. 22941 | ESTs | TM | 2.1 |
| 417666 | AI345001 | Hs. 82380 | menage a trois 1 (CAK assembly fac | zf-C3HC4 | 2.1 |
| 428485 | NM_002950 | Hs. 2280 | ribophorin I | TM | 2.1 |
| 445798 | NM_012421 | Hs. 13321 | rearranged L-myc fusion sequence | TM, zf-C2H2 | 2.1 |
| 430057 | AW450303 | Hs. 2534 | bone morphogenetic protein recepto | TM, Activin_recp, pkina | 2.1 |
| 425189 | H16622 | | gb: ym26c07 r1 Soares infant brain 1 | RasGEF, PH, fibrinogen_ | 2.1 |
| 413063 | AL035737 | Hs. 75184 | chitinase 3-like 1 (cartilage glycopro | SS, Glyco_hydro_18 | 2.1 |
| 421343 | BE246444 | Hs. 283685 | hypothetical protein FLJ20396 | TM | 2.1 |
| 425627 | AF019612 | Hs. 297007 | ESTs | TM, Peptidase_M50 | 2.1 |
| 426261 | AW242243 | Hs. 168670 | peroxisomal farnesylated protein | E1-E2_ATPase, Cation_ | 2.1 |
| 431638 | NM_000916 | Hs. 2820 | oxytocin receptor | TM, 7tm_1 | 2.1 |
| 456546 | AI690321 | Hs. 203845 | ESTs, Weakly similar to TWIK-rela | TM | 2.1 |
| 421685 | AF189723 | Hs. 106778 | calcium transport ATPase ATP2C1 | TM, E1-E2_ATPase, Hy | 2.1 |
| 424099 | AF071202 | Hs. 139336 | ATP-binding cassette, sub-family C | TM, ABC_tran, ABC_m | 2.1 |
| 424800 | AL035588 | Hs. 153203 | MyoD family inhibitor | TM | 2.1 |
| 410007 | AW950887 | Hs. 57813 | zinc nbbon domain containing, 1 | TFIIS | 2.1 |
| 436135 | D85390 | Hs. 5057 | carboxypeptidase D | SS, Zn_carbOpept | 2.1 |
| 420633 | NM_014581 | Hs. 99526 | odorant-binding protein 2B | TM, lipocalin | 2.1 |
| 420162 | BE378432 | Hs. 95577 | cyclin-dependent kinase 4 | pkinase, ank, ArfGap, PH | 2.1 |
| 426156 | BE244537 | Hs. 167382 | natriuretic peptide receptor A/guany | TM, ANF_receptor, guan | 2.0 |
| 442711 | AF151073 | Hs. 8645 | hypothetical protein | TM | 2.0 |
| 411872 | AW327356 | Hs. 90918 | chromosome 11 open reading frame | TM | 2.0 |
| 427801 | AW979155 | Hs. 234433 | hypothetical protein PRO1068 | TM, Aa_trans | 2.0 |
| 430268 | AK000737 | Hs. 237480 | hypothetical protein FLJ20730 | TM | 2.0 |
| 431183 | NM_006855 | Hs. 250696 | KDEL (Lys-Asp-Glu-Leu) endoplas | TM, ER_lumen_recept, I | 2.0 |
| 431846 | BE019924 | Hs. 271580 | Uroplakin 1B | TM, transmembrane4 | 2.0 |
| 404210 | U02478 | Hs. 100469 | Human AF-6 mRNA | TM, RA, DIL, PDZ, FHA | 2.0 |
| 435640 | AF220053 | Hs. 54960 | uncharacterized hematopeietic stem/ | TM, SET, zf-CXXC, PHD | 2.0 |
| 447906 | AL050062 | Hs. 19999 | DKFZP566K023 protein | SS | 2.0 |
| 412666 | AL080116 | Hs. 74420 | origin recognition complex, subunit | TM | 2.0 |
| 417181 | L10123 | Hs. 1071 | surfactant protein A binding protein | TM | 2.0 |
| 423945 | AA410943 | Hs. 72472 | BMPR-Ib: bone morphogenetic pro | TM, pkinase, Activin_rec | 2.0 |
| 411773 | NM_006799 | Hs. 72026 | protease, serine, 21 (testisin) | SS, trypsin | 2.0 |
| 448350 | L14561 | Hs. 78546 | *Homo sapiens* clone 24411 mRNA s | TM, E1-E2_ATPase, Hy | 2.0 |
| 401093 | AI955244 | Hs. 121520 | HYPOTHETICAL 16 4 kDa PROTE | TM, LRRCT | 2.0 |
| 415664 | NM_004939 | Hs. 78580 | DEAD/H (Asp-Glu-Ala-Asp/His) bo | DEAD, helicase_C, SPRY | 2.0 |
| 448165 | NM_005591 | Hs. 202379 | meiotic recombination (S cerevisiae | DNA_repair, Glyco_tran | 2.0 |
| 416391 | AI878927 | Hs. 79284 | mesoderm specific transcript (mouse | TM, abhydrolase | 2.0 |
| 422926 | NM_016102 | Hs. 121748 | ring finger protein 16 | SPRY, zf-C3HC4 zf-B_ | 2.0 |
| 446849 | AU076617 | Hs. 16251 | cleavage and polyadenylation specif | TM | 2.0 |
| 427617 | D42063 | Hs. 179825 | RAN binding protein 2-like 1 | TM, Ran_BP1, zf-RanBP | 2.0 |

TABLE 11A-continued

ABOUT 222 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 411678 | AI907114 | Hs. 71465 | squalene epoxidase | TM, Monooxygenase | 2.0 |
| 432554 | AI479813 | Hs. 278411 | NCK-associated protein 1 | TM | 2.0 |

Pkey: Primekey
Ex. Accn: Exemplar Accession
UG ID: UniGene ID
Title: UniGene title
PFAM domains: predicted protein structural domains
ratio: ratio tumor vs normal tissue
In Pkey 431183, KDEL (Lys-Asp-Glu-Leu) endoplasmic reticulum retention sequence = SEQ ID NO:163.

TABLE 11B

| Pkey | CAT Number | Accession |
|---|---|---|
| 417742 | 1696282_1 | R64719 Z44680 R12451 |
| 425189 | 247825_1 | H16622 R17322 AA351959 |

Pkey: Unique Eos probeset identifier number

CAT number Gene cluster number

Accession Genbank accession numbers

TABLE 11C

| Pkey | Ref | Strand | Nt_position |
|---|---|---|---|
| 400534 | 6981826 | Minus | 278637–279292 |
| 401197 | 9719705 | Plus | 176341–176452 |

Pkey: Unique number corresponding to an Eos probeset
Ref: Sequence source The 7 digit numbers in this column are Genbank Identifier (GI) numbers. "Dunham I. et al." refers to the publication entitled "The DNA sequence of human chromosome 22" Dunham I et al. (1999) Nature 402: 489–495.
Strand Indicates DNA strand from which exons were predicted.
Nt_position Indicates nucleotide positions of predicted exons.

Table 12A lists about 57 genes up-regulated in ovarian cancer compared to normal adult tissues that are likely to encode either enzymes or proteins amenable to modulation by small molecules. These were selected as for Table 10A, except that the ratio was greater than or equal to 2 0, and the predicted protein contained a structural domain that is indicative of enzymatic function or of being modulated by small molecules (e g, pkinase, peptidase, isomerase, transporters) Predicted protein domains are noted.

TABLE 12A

ABOUT 57 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 400292 | AA250737 | Hs. 72472 | BMPR-Ib, bone morphogenetic pro | pkinase, Activin_recp | 30.0 |
| 400289 | X07820 | Hs. 2258 | Matrix Metalloproteinase 10 (Strom | SS,, Peptidase_M10 | 25.2 |
| 426427 | M86699 | Hs. 169840 | TTK protein kinase | pkinase | 18.7 |
| 424905 | NM_002497 | Hs. 153704 | NIMA (never in mitosis gene a)-rela | pkinase | 16.2 |
| 433159 | AB035898 | Hs. 150587 | kinesin-like protein 2 | kinesin | 11.5 |
| 453370 | AI470523 | Hs. 182356 | ESTs, Moderately similar to translat | ABC_tran | 8.4 |
| 418007 | M13509 | Hs. 83169 | Matrix metalloprotease 1 (interstitia | SS,, Peptidase_M10 | 7.2 |
| 425465 | L18964 | Hs. 1904 | protein kinase C, iota | Ski_Sno, pkinase_C | 6.1 |
| 409506 | NM_006153 | Hs. 54589 | NCK adaptor protein 1 | SH2, SH3 | 5.2 |
| 415539 | AI733881 | Hs. 72472 | BMPR-Ib, bone morphogenetic pro | pkinase, Activin_recp | 5.1 |
| 424539 | L02911 | Hs. 150402 | activin A receptor, type I | Activin_recp, pkinase | 4.8 |
| 400296 | AA305627 | Hs. 139336 | ATP-binding cassette, sub-family C | TM, ABC_tran | 4.6 |
| 431699 | NM_001173 | Hs. 267831 | Homo sapiens cDNA FLJ12952 fis, | RhoGAP, FF, ras | 3.9 |
| 439560 | BE565647 | Hs. 74899 | hypothetical protein FLJ12820 | C2, PI-PLC-Y, PI-PLC-X | 3.8 |
| 450447 | AF212223 | Hs. 25010 | hypothetical protein P15-2 | ANF_receptor , pkinase | 3.6 |
| 400666 | X07820 | Hs. 2258 | Matrix Metalloproteinase 10 (Strom | SS,, Peptidase_M10 | 3.5 |
| 452822 | X85689 | Hs. 288617 | Homo sapiens cDNA FLJ22621 fis, | EGF, fn3, pkinase | 3.4 |
| 416530 | U62801 | Hs. 79361 | kallikrein 6 (neurosin, zyme) | SS, TM, trypsin | 3.3 |
| 411393 | AW797437 | Hs. 69771 | B-factor, properdin | SS, sushi, trypsin, vwa, fn3, | 3.2 |
| 444755 | AA431791 | Hs. 183001 | ESTs | AAA | 3.2 |
| 418836 | AI655499 | Hs. 161712 | ESTs | pkinase, Activin_recp | 3.2 |
| 409178 | BE393948 | Hs. 50915 | kallikrein 5 | SS, trypsin | 3.1 |
| 406687 | M31126 | Hs. 272620 | pregnancy specific beta-1-glycoprot | SS, Peptidase_M10, , ig | 3.1 |
| 453920 | AI133148 | Hs. 36602 | I factor (complement) | Idl_recept_a, trypsin, SRCR | 3.0 |
| 404653 | AA923729 | Hs. 26322 | 0 | pkinase | 2.9 |
| 419452 | U33635 | Hs. 90572 | PTK7 protein tyrosine kinase 7 | TM, pkinase, ig | 2.9 |

TABLE 12A-continued

ABOUT 57 UP-REGULATED GENES ENCODING EXTRACELLULAR/CELL SURFACE PROTEINS, OVARIAN CANCER VERSUS NORMAL ADULT TISSUES

| Pkey | Ex Accn | UG ID | Title | PFAM domains | ratio |
|---|---|---|---|---|---|
| 418848 | AI820961 | Hs. 193465 | ESTs | pkinase, Activin_recp | 2.9 |
| 428450 | NM_014791 | Hs. 184339 | KIAA0175 gene product | TM, pkinase, KA1 | 2.8 |
| 401323 | AL158037 | | predicted exon | lactamase_B | 2.7 |
| 444798 | BE242144 | Hs. 12013 | ATP-binding cassette, sub-family E | SH3, pkinase , ABC_tran | 2.7 |
| 432201 | AI538613 | Hs. 135657 | TMPRSS3a mRNA for serine protea | trefoil, trypsin | 2.6 |
| 448402 | BE244226 | Hs. 21094 | RAB18, member RAS oncogene fam | ras, arf | 2.6 |
| 406671 | AA129547 | Hs. 285754 | met proto-oncogene (hepatocyte gro | pkinase, Sema | 2.5 |
| 453448 | AL036710 | Hs. 209527 | ESTs | CNH, pkinase | 2.5 |
| 414386 | X00442 | Hs. 75990 | haptoglobin | sushi, trypsin | 2.5 |
| 421270 | H56037 | Hs. 108146 | ESTs | RhoGAP | 2.4 |
| 414695 | BE439915 | Hs. 76913 | proteasome (prosome, macropain) su | proteasome | 2.4 |
| 431341 | AA307211 | Hs. 251531 | proteasome (prosome, macropain) su | proteasome | 2.4 |
| 424085 | NM_002914 | Hs. 139226 | replication factor C (activator 1) 2 (4 | AAA, Viral_helicase 1 | 2.2 |
| 424687 | J05070 | Hs. 151738 | matrix metalloproteinase 9 (gelatina | SS, fn2, , Peptidase_M10 | 2.2 |
| 416517 | AA775987 | Hs. 79357 | proteasome (prosome, macropain) 26 | AAA | 2.2 |
| 417601 | NM_014735 | Hs. 82292 | KIAA0215 gene product | PHD | 2.1 |
| 400509 | M97639 | Hs. 155585 | receptor tyrosine kinase-like orphan | pro_isomerase | 2.1 |
| 430057 | AW450303 | Hs. 2534 | bone morphogenetic protein recepto | Activin_recp, pkinase | 2.1 |
| 421841 | AA908197 | Hs. 108850 | KIAA0936 protein | TPR, pkinase | 2.1 |
| 453078 | AF053551 | Hs. 31584 | metaxin 2 | pro_isomerase | 2.1 |
| 424099 | AF071202 | Hs. 139336 | ATP-binding cassette; sub-family C | TM, ABC_tran | 2.1 |
| 411190 | AA306342 | Hs. 69171 | protein kinase C-like 2 | pkinase, pkinase_C, HR1 | 2.1 |
| 407740 | AA295547 | Hs. 62666 | ESTs | p450 | 2.1 |
| 420162 | BE378432 | Hs. 95577 | cyclin-dependent kinase 4 | pkinase, ank, ArfGap , ras | 2.1 |
| 420490 | H69894 | Hs. 193041 | ESTs | PI3Ka, PI3_PI4_kinase | 2.1 |
| 426156 | BE244537 | Hs. 167382 | natnuretic peptide receptor A/guany | TM, ANF_receptor , pkinase | 2.0 |
| 423945 | AA410943 | Hs. 72472 | BMPR-Ib, bone merphogenetic pro | TM, pkinase, Activin_recp | 2.0 |
| 411773 | NM_006799 | Hs. 72026 | protease, serine, 21 (testisin) | SS, trypsin | 2.0 |
| 447298 | BE617527 | Hs. 180450 | ribosomal protein S24 | PI3Ka, P14_kinase | 2.0 |
| 427617 | D42063 | Hs. 179825 | RAN binding protein 2-like 1 | TPR, pro_isomerase | 2.0 |
| 453546 | AF042385 | Hs. 33251 | peptidylprolyl isomerase E (cycloph | pro_isomerase, rrm | 2.0 |

Pkey: Primekey
Ex. Accn Exemplar Accession
UG ID. UniGene ID
Title: UniGene title
PFAM domains predicted structural domains
ratio: ratio tumor vs normal

TABLE 12C

| Pkey | Ref | Strand | Nt_position |
|---|---|---|---|
| 401323 | 9212516 | Plus | 213509–214450 |

Pkey: Unique number corresponding to an Eos probeset
Ref: Sequence source The 7 digit numbers in this column are Genbank Identifier (GI) numbers "Dunham I et al." refers to the publication entitled "The DNA sequence of human chromosome 22" Dunham, et al. (1999) Nature 402 489–495
Strand Indicates DNA strand from which exons were predicted
Nt_position Indicates nucleotide positions of predicted exons Table 13A lists about 1086 genes up-regulated in ovarian cancer compared to normal ovaries. These were selected as for Table 10A, except that the ratio was greater than or equal to 10, and the denominator was the median value for various non-malignant ovary specimens.

TABLE 13A

About 1086 UP-REGULATED GENES, OVARIAN CANCER VERSUS NORMAL OVARY

| Pkey | Ex. Accn | UG ID | Title | ratio |
|---|---|---|---|---|
| 439706 | AW872527 | Hs. 59761 | ESTs | 109.2 |
| 446619 | AU076643 | Hs. 313 | secreted phosphoprotein 1 (osteopontin, bone | 107.8 |
| 422095 | AI868872 | Hs. 288966 | ceruloplasmin (ferroxidase) | 104.4 |
| 447111 | AI017574 | Hs. 17409 | cysteine-rich protein 1 (intestinal) | 88.3 |
| 431130 | NM_006103 | Hs. 2719 | epididymis-specific, whey-acidic protein type | 82.8 |
| 431369 | BE184455 | Hs. 251754 | secretory leukocyte protease inhibitor (antil | 81.9 |
| 413859 | AW992356 | Hs. 8364 | ESTs | 73.9 |
| 446291 | BE397753 | Hs. 14623 | interferon, gamma-inducible protein 30 | 72.7 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 426050 | AF017307 | Hs. 166096 | E74-like factor 3 (ets domain transcription f | 68.1 |
| 411469 | T09997 | Hs. 70327 | cysteine-rich protein 2 | 66.6 |
| 429504 | X99133 | Hs. 204238 | lipocalin 2 (oncogene 24p3) | 65.7 |
| 416971 | R34657 | Hs. 80658 | uncoupling protein 2 (mitochondrial, proton c | 64.9 |
| 450273 | AW296454 | Hs. 24743 | hypothetical protein FLJ20171 | 62.5 |
| 446441 | AK001782 | Hs. 15093 | hypothetical protein | 60.7 |
| 428758 | AA433988 | Hs. 98502 | *Homo sapiens* cDNA: FLJ14303 fis, clone PLACE20 | 59.7 |
| 441406 | Z45957 | Hs. 7837 | *Homo sapiens* cDNA: FLJ10457 fis, clone NT2RP10 | 57.8 |
| 441859 | AW194364 | Hs. 128022 | ESTs, Weakly similar to FIG1 MOUSE FIG-1 PROT | 56.7 |
| 448406 | AW772298 | Hs. 21103 | *Homo sapiens* mRNA, cDNA DKFZp564B076 | 55.7 |
| 414602 | AW630088 | Hs. 76550 | *Homo sapiens* mRNA, cDNA DKFZp564B1264 | 55.2 |
| 418068 | AW971155 | Hs. 293902 | ESTs, Weakly similar to prolyl 4-hydroxylase | 54.8 |
| 428330 | L22524 | Hs. 2256 | matrix metalloproteinase 7 (matrilysin, uteri | 53.4 |
| 412636 | NM_004415 | Hs. 74316 | desmoplakin (DPI, DPII) | 51.4 |
| 430634 | AI860651 | Hs. 26685 | ESTs | 50.7 |
| 439318 | AW837046 | Hs. 6527 | G protein-coupled receptor 56 | 50.7 |
| 417259 | AW903838 | Hs. 81800 | chondroitin sulfate proteoglycan 2 (versican) | 50.6 |
| 407786 | AA687538 | Hs. 38972 | tetraspan 1 | 50.4 |
| 426836 | N41720 | Hs. 172684 | vesicle-associated membrane protein 8 (endobr | 49.7 |
| 417308 | H60720 | Hs. 81892 | KIAA0101 gene product | 48.9 |
| 436876 | AI124756 | Hs. 5337 | isocitrate dehydrogenase 2 (NADP+), mitochond | 48.4 |
| 439180 | AI393742 | Hs. 199067 | v-erb-b2 avian erythroblastic leukemia viral | 47.1 |
| 428289 | M26301 | Hs. 2253 | complement component 2 | 46.3 |
| 405484 | | | 0 | 46.1 |
| 425371 | D49441 | Hs. 155981 | mesothelin | 45.7 |
| 403912 | | | 0 | 45.0 |
| 443021 | AA368546 | Hs. 8904 | Ig superfamily protein | 44.6 |
| 427697 | T18997 | Hs. 180372 | BCL2-like 1 | 44.3 |
| 428227 | AA321649 | Hs. 2248 | INTERFERON-GAMMA INDUCED PROTEIN | 44.0 |
| 404678 | | | 0 | 43.9 |
| 400289 | X07820 | Hs. 2258 | Matrix Metalloproteinase 10 (Stromolysin 2) | 43.8 |
| 451035 | AU076785 | Hs. 430 | plastin 1(I isoform) | 43.8 |
| 440848 | BE314650 | Hs. 7476 | ATPase, H+transporting, lysosomal (vacuolar | 42.8 |
| 436278 | BE396290 | Hs. 5097 | synaptogyrin 2 | 42.4 |
| 413936 | AF113676 | Hs. 75621 | serine (or cysteine) proteinase inhibitor, cl | 42.1 |
| 420859 | AW468397 | Hs. 100000 | S100 calcium-binding protein A8 (calgranulin | 42.1 |
| 428411 | AW291464 | Hs. 10338 | ESTs | 41.8 |
| 422166 | W72424 | Hs. 112405 | S100 calcium-binding protein A9 (calgranulin | 41.5 |
| 412477 | AA150864 | Hs. 790 | microsomal glutathione S-transferase 1 | 40.7 |
| 417130 | AW276858 | Hs. 81256 | S100 calcium-binding protein A4 (calcium prot | 40.1 |
| 424673 | AA345051 | Hs. 294092 | ESTs | 39.8 |
| 416530 | U62801 | Hs. 79361 | kallikrein 6 (neurosin, zyme) | 39.7 |
| 443162 | T49951 | Hs. 9029 | ESTs, Highly similar to KERATIN, TYPE I CYTO | 39.5 |
| 413719 | BE439580 | Hs. 75498 | small inducible cytokine subfamily A (Cys-Cys | 39.3 |
| 424687 | J05070 | Hs. 151738 | matrix metalloproteinase 9 (gelatinase B, 92 k | 38.9 |
| 413063 | AL035737 | Hs. 75184 | chitinase 3-like 1 (cartilage glycoprotein-39 | 38.5 |
| 429441 | AJ224172 | Hs. 204096 | lipophilin B (uteroglobin family member), pro | 38.1 |
| 418526 | BE019020 | Hs. 85838 | solute carrier family 16 (monocarboxylic acid | 37.9 |
| 415511 | AI732617 | Hs. 182362 | ESTs | 37.7 |
| 409453 | AI885516 | Hs. 95612 | ESTs | 37.7 |
| 445537 | AJ245671 | Hs. 12844 | EGF-like-domain, multiple 6 | 37.3 |
| 442432 | BE093589 | Hs. 38178 | *Homo sapiens* cDNA: FLJ23468 fis, clone HSI116 | 37.3 |
| 408243 | Y00787 | Hs. 624 | interleukin 8 | 37.3 |
| 419092 | J05581 | Hs. 89603 | mucin 1, transmembrane | 36.7 |
| 444172 | BE147740 | Hs. 104558 | ESTs | 36.0 |
| 412115 | AK001763 | Hs. 73239 | hypothetical protein FLJ10901 | 35.8 |
| 420440 | NM_002407 | Hs. 97644 | mammaglobin 2 | 35.7 |
| 414386 | X00442 | Hs. 75990 | haptoglobin | 35.3 |
| 423225 | AA852604 | Hs. 125359 | Thy-1 cell surface antigen | 35.1 |
| 440596 | H13032 | Hs. 103378 | ESTs, Weakly similar to DRR1 [*H. sapiens*] | 35.0 |
| 413278 | BE563085 | Hs. 833 | interferon-stimulated protein, 15 kDa | 34.9 |
| 418506 | AA084248 | Hs. 85339 | G protein-coupled receptor 39 | 34.8 |
| 445919 | T53519 | Hs. 290357 | ESTs | 34.7 |
| 416854 | H40164 | Hs. 80296 | Purkinje cell protein 4 | 34.4 |
| 414186 | U33446 | Hs. 75799 | protease, serine, 8 (prostasin) | 34.2 |
| 434371 | AA631362 | | gb: np86b01.s1 NCI_CGAP_Thy1 *Homo sapiens* cDNA | 33.9 |
| 421937 | AI878857 | Hs. 109706 | HN1 protein | 33.9 |
| 449722 | BE280074 | Hs. 23960 | cyclin B1 | 33.8 |
| 400965 | | | 0 | 33.7 |
| 452203 | X57522 | Hs. 158164 | ATP-binding cassette, sub-family B (MDR/TAP), | 33.5 |
| 411945 | AL033527 | Hs. 92137 | v-myc avian myelocytomatosis viral oncogene h | 33.5 |
| 425811 | AL039104 | Hs. 159557 | karyopherin alpha 2 (RAG cohort 1, importin a | 33.4 |
| 408901 | AK001330 | Hs. 48855 | hypothetical protein FLJ10468 | 33.3 |
| 438461 | AW075485 | Hs. 286049 | phosphoserine aminotransferase | 33.3 |
| 422963 | M79141 | Hs. 13234 | ESTs | 33.3 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 426158 | NM_001982 | Hs. 199067 | v-erb-b2 avian erythroblastic leukemia viral | 33.2 |
| 431836 | AF178532 | Hs. 271411 | beta-site APP-cleaving enzyme 2 | 32.8 |
| 421502 | AF111856 | Hs. 105039 | solute carrier family 34 (sodium phosphate), | 32.5 |
| 431211 | M86849 | Hs. 5566 | Homo sapiens connexin 26 (GJB2) mRNA, complet | 32.5 |
| 436552 | NM_014038 | Hs. 5216 | HSPC028 protein | 32.5 |
| 442533 | AA161224 | Hs. 8372 | ubiquinol-cytochrome c reductase (6.4kD) subu | 32.5 |
| 406400 | AA343629 | Hs. 104570 | kallikrein 8 (neuropsin/ovasin) | 32.4 |
| 450353 | AI244661 | Hs. 103296 | ESTs | 32.4 |
| 422158 | L10343 | Hs. 112341 | protease inhibitor 3, skin-derived (SKALP) | 32.4 |
| 433412 | AV653729 | Hs. 8185 | CGI-44 protein, sulfide dehydrogenase like (y | 32.3 |
| 441020 | W79283 | Hs. 35962 | ESTs | 32.2 |
| 432201 | AI538613 | Hs. 135657 | TMPRSS3a mRNA for serine protease (ECHOS1) (T | 32.0 |
| 424125 | M31669 | Hs. 1735 | inhibin, beta B (activin AB beta polypeptide) | 31.9 |
| 453309 | AI791809 | Hs. 32949 | defensin, beta 1 | 31.8 |
| 408380 | AF123050 | Hs. 44532 | diubiquitin | 31.7 |
| 419329 | AY007220 | Hs. 288998 | S100-type calcium binding protein A14 | 31.6 |
| 409231 | AA446644 | Hs. 692 | GA733-2; epithelial glycoprotein (EGP) (KSA) | 31.6 |
| 423961 | D13666 | Hs. 136348 | Homo sapiens mRNA for osteoblast specific fac | 31.2 |
| 413840 | AI301558 | Hs. 290801 | ESTs | 30.8 |
| 440943 | AW082298 | Hs. 146161 | ESTs, Weakly similar to KIAA0859 protein [H.s | 30.8 |
| 419239 | AA468183 | Hs. 184598 | Homo sapiens cDNA: FLJ23241 fis, clone COL013 | 30.4 |
| 410132 | NM_003480 | Hs. 58882 | Microfibril-associated glycoprotein-2 | 30.2 |
| 418203 | X54942 | Hs. 83758 | CDC28 protein kinase 2 | 30.1 |
| 412719 | AW016610 | Hs. 129911 | ESTs | 30.0 |
| 407862 | BE548267 | Hs. 50724 | Homo sapiens cDNA: FLJ10934 fis, clone OVARC10 | 30.0 |
| 431563 | AI027643 | Hs. 120912 | ESTs | 29.9 |
| 431743 | AW972642 | Hs. 293055 | ESTs | 29.8 |
| 443295 | AI049783 | Hs. 241284 | ESTs | 29.7 |
| 413745 | AW247252 | Hs. 75514 | nucleoside phosphorylase | 29.7 |
| 441028 | AI333660 | Hs. 17558 | ESTs | 29.6 |
| 442315 | AA173992 | Hs. 7956 | ESTs | 29.6 |
| 452838 | U65011 | Hs. 30743 | Preferentially expressed antigen in melanoma | 29.5 |
| 428479 | Y00272 | Hs. 184572 | cell division cycle 2, G1 to S and G2 to M | 29.5 |
| 432280 | BE440142 | Hs. 2943 | signal recognition particle 19 kD | 29.4 |
| 420158 | AI791905 | Hs. 95549 | hypothetical protein | 29.3 |
| 445033 | AV652402 | Hs. 155145 | ESTs | 29.2 |
| 452367 | U71207 | Hs. 29279 | eyes absent (Drosophila) homolog 2 | 29.1 |
| 432706 | NM_013230 | Hs. 286124 | CD24 | 29.0 |
| 422163 | AF027208 | Hs. 297332 | prominin (mouse)-like 1 | 28.7 |
| 447035 | NM_004753 | Hs. 17144 | short-chain dehydrogenase/reductase 1 | 28.6 |
| 443958 | BE241880 | Hs. 10029 | cathepsin C | 28.2 |
| 422956 | BE545072 | Hs. 122579 | ESTs | 28.1 |
| 450377 | AB033091 | Hs. 24936 | ESTs | 28.0 |
| 447471 | AF039843 | Hs. 18676 | sprouty (Drosophila) homolog 2 | 28.0 |
| 444725 | AW952022 | Hs. 234174 | Homo sapiens cDNA: FLJ13819 fis, clone THYRO10 | 27.8 |
| 430250 | NM_016929 | Hs. 283021 | chloride intracellular channel 5 | 27.7 |
| 416305 | AU076628 | Hs. 79187 | coxsackie virus and adenovirus receptor | 27.6 |
| 418174 | L20688 | Hs. 83656 | Rho GDP dissociation inhibitor (GDI) beta | 27.5 |
| 417233 | W25005 | Hs. 24395 | small inducible cytokine subfamily B (Cys-X-C | 27.4 |
| 417866 | AW067903 | Hs. 82772 | collagen, type XI, alpha 1 | 27.3 |
| 427344 | NM_000869 | Hs. 2142 | 5-hydroxytryptamine (serotonin) receptor 3A | 27.2 |
| 442993 | BE018682 | Hs. 44343 | ESTs | 27.2 |
| 407137 | T97307 | Hs. 199067 | v-erb-b2 avian erythroblastic leukemia viral | 27.0 |
| 419356 | AI656166 | Hs. 7331 | ESTs | 27.0 |
| 433662 | W07162 | Hs. 150826 | CATX-8 protein | 26.7 |
| 422576 | BE548555 | Hs. 118554 | CGI-83 protein | 26.4 |
| 423271 | W47225 | Hs. 126256 | interleukin 1, beta | 26.3 |
| 443715 | AI583187 | Hs. 9700 | cyclin E1 | 26.1 |
| 420816 | NM_015925 | Hs. 95697 | liver-specific bHLH-Zip transcription factor | 26.0 |
| 419551 | AW582256 | Hs. 91011 | antenor gradient 2 (Xenepus laevis) homolog | 25.9 |
| 443672 | AA323362 | Hs. 9667 | butyrobetaine (gamma), 2-oxoglutarate dioxyge | 25.8 |
| 416889 | AW250318 | Hs. 80395 | mal, T-cell differentiation protein | 25.3 |
| 408474 | AA188823 | Hs. 83196 | Homo sapiens cDNA: FLJ23597 fis, clone LNG152 | 25.3 |
| 411825 | AK000334 | Hs. 72289 | hypothetical protein FLJ20327 | 25.3 |
| 400881 | | | 0 | 25.2 |
| 440594 | AW445167 | Hs. 126036 | ESTs | 25.1 |
| 414586 | AA306160 | Hs. 76506 | lymphocyte cytosolic protein 1 (L-plastin) | 25.1 |
| 411925 | AW014588 | Hs. 72925 | chromosome 11 open reading frame 13 | 25.1 |
| 417869 | BE076254 | Hs. 82793 | proteasome (prosome, macropain) subunit, beta | 25.0 |
| 433447 | U29195 | Hs. 3281 | neuronal pentranin II | 25.0 |
| 450858 | C18458 | Hs. 25597 | elongation of very long chain fatty acids (FE | 24.8 |
| 410619 | BE512730 | Hs. 65114 | keratin 18 | 24.8 |
| 434094 | AA305599 | Hs. 238205 | hypothetical protein PRO2013 | 24.6 |
| 421924 | BE514514 | Hs. 109606 | coronin, actin-binding protein, 1A | 24.6 |
| 446859 | AI494299 | Hs. 16297 | COX17 (yeast) homolog, cytochrome c oxidase a | 24.5 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 421451 | AA291377 | Hs. 50831 | ESTs | 24.3 |
| 433929 | AI375499 | Hs. 27379 | ESTs | 24.3 |
| 438930 | AW843633 | Hs. 81256 | S100 calcium-binding protein A4 (calcium prot | 24.2 |
| 444212 | AW503976 | Hs. 10649 | basement membrane-induced gene | 24.2 |
| 441633 | AW958544 | Hs. 112242 | ESTs | 24.2 |
| 441134 | W29092 | Hs. 7678 | cellular retinoic acid-binding protein 1 | 24.2 |
| 417715 | AW969587 | Hs. 86366 | ESTs | 24.1 |
| 409361 | NM_005982 | Hs. 54416 | sine oculis homeobon (Drosophila) homolog 1 | 24.1 |
| 416984 | H38765 | Hs. 80706 | diaphorase (NADH/NADPH) (cytochrome b-5 reduc | 24.1 |
| 430125 | U46418 | Hs. 233950 | serine protease inhibitor, Kunitz type 1 | 23.9 |
| 434078 | AW880709 | Hs. 283683 | EST | 23.8 |
| 408669 | AI493591 | Hs. 78146 | platelet/endothelial cell adhesion molecule ( | 23.8 |
| 439413 | AI598252 | Hs. 37810 | ESTs | 23.7 |
| 449034 | AI624049 | Hs. 277523 | gb: ts41a09 x1 NCI_CGAP_Ut1 Homo sapiens cDNA | 23.7 |
| 420344 | BE463721 | Hs. 97101 | Putative G protein-coupled receptor GPCR150 | 23.6 |
| 431243 | U46455 | Hs. 252189 | syndecan 4 (amphiglycan, ryundocan) | 23.6 |
| 417515 | L24203 | Hs. 82237 | ataxia-telangiectasia group D-associated prot | 23.5 |
| 451267 | AI033894 | Hs. 117865 | solute carrer family 17 (anion/sugar transpo | 23.4 |
| 450101 | AV649989 | Hs. 24385 | Human hbc647 mRNA sequence | 23.4 |
| 419693 | AA133749 | Hs. 92323 | FXYD domain-containing ion transport regulato | 23.4 |
| 431103 | M57399 | Hs. 44 | pleiotrophin (heparin binding growth factor 8 | 23.4 |
| 451110 | AI955040 | Hs. 301584 | ESTS | 23.3 |
| 426295 | AW367283 | Hs. 75839 | zinc finger protein 6 (CMPX1) | 23.2 |
| 448517 | AA082750 | Hs. 42194 | hypothetical protein FLJ22649 similar to sign | 23.1 |
| 424670 | W61215 | Hs. 116651 | epithelial V-like antigen 1 | 23.1 |
| 417847 | AI521558 | Hs. 288312 | Homo sapiens cDNA: FLJ22316 fis, clone HRC052 | 23.1 |
| 449027 | AJ271216 | Hs. 22880 | dipeptidylpeptidase III | 23.1 |
| 424969 | AW950928 | Hs. 153998 | creatine kinase, mitochondrinal 1 (ubiquitous) | 23.1 |
| 433159 | AB035898 | Hs. 150587 | kinesin-like protein 2 | 23.0 |
| 411393 | AW797437 | Hs. 69771 | B-factor, properdin | 23.0 |
| 434815 | AF155582 | Hs. 46744 | core1 UDP-galactose N-acetylgalactosamine-alp | 22.8 |
| 427585 | D31152 | Hs. 179729 | collagen; type X, alpha 1 (Schmid metaphyseal | 22.7 |
| 445721 | H92136 | Hs. 13144 | HSPC160 protein | 22.6 |
| 448258 | BE386983 | Hs. 85015 | ESTs, Weakly similar to A4P_HUMAN INTESTINAL | 22.6 |
| 456844 | AI264155 | Hs. 152981 | CDP-diacylglycerol synthase (phosphatidate cy | 22.6 |
| 452698 | NM_001295 | Hs. 301921 | ESTs | 22.5 |
| 418693 | AI750878 | Hs. 87409 | thrombospondin 1 | 22.4 |
| 414880 | AW247305 | Hs. 119140 | eukaryotic translation initiation factor 5A | 22.4 |
| 401519 | | | 0 | 22.3 |
| 402496 | | | 0 | 22.3 |
| 420324 | AF163474 | Hs. 96744 | DKFZP586D0823 protein, Prostate androgen-regu | 22.3 |
| 403022 | | | 0 | 22.2 |
| 434042 | AI589941 | Hs. 8254 | hypothetical protein PRO0899 | 22.1 |
| 419080 | AW150835 | Hs. 18878 | hypothetical protein FLJ21620 | 22.1 |
| 406545 | AB018249 | Hs. 10458 | small inducible cytokine subfamily A (Cys-Cys | 22.1 |
| 447362 | AW176120 | Hs. 9061 | ESTs | 22.0 |
| 429547 | AW009166 | Hs. 99376 | ESTs | 22.0 |
| 427954 | J03060 | Hs. 247551 | metaxin 1 | 22.0 |
| 423161 | AL049227 | Hs. 124776 | Homo sapiens mRNA, cDNA DKFZp564N1116 (from c | 22.0 |
| 428392 | H10233 | Hs. 2265 | secretory granule, neuroendocrine protein 1 ( | 21.9 |
| 444107 | T46839 | Hs. 10319 | UDP glycosyltransferase 2 family, polypeptide | 21.7 |
| 414421 | AI521130 | Hs. 55567 | ESTs, Weakly similar to LAK-4p [H. sapiens] | 21.5 |
| 412589 | R28660 | Hs. 24305 | ESTs | 21.5 |
| 446525 | AW967069 | Hs. 211556 | Homo sapiens cDNA: FLJ23378 fis, clone HEP162 | 21.5 |
| 416847 | L43821 | Hs. 80261 | enhancer of filamentation 1 (cas-like docking | 21.5 |
| 436972 | AA284679 | Hs. 25640 | claudin 3 | 21.5 |
| 428698 | AA852773 | Hs. 297939 | ESTs, Weakly similar to neogenin [H. sapiens] | 21.5 |
| 421340 | F07783 | Hs. 1369 | decay accelerating factor for complement (CD5 | 21.4 |
| 413966 | AA133935 | Hs. 173704 | ESTs | 21.4 |
| 448243 | AW369771 | Hs. 77496 | ESTs | 21.3 |
| 421928 | AF013758 | Hs. 109643 | polyadenylate binding protein-interacting pro | 21.3 |
| 403399 | | | 0 | 21.3 |
| 435793 | AB037734 | Hs. 4993 | ESTs | 21.3 |
| 432629 | AW860548 | Hs. 280658 | ESTs | 21.2 |
| 449057 | AB037784 | Hs. 22941 | ESTs | 21.1 |
| 437575 | AW954355 | Hs. 36529 | ESTs | 21.2 |
| 401131 | | | 0 | 21.0 |
| 407207 | T03651 | Hs. 179661 | tubulin, beta polypeptide | 20.8 |
| 444783 | AK001468 | Hs. 62180 | ESTs | 20.8 |
| 426230 | AA367019 | Hs. 241395 | protease, serine, 1 (trypsin 1) | 20.8 |
| 447343 | AA256641 | Hs. 236894 | ESTs, Highly similar to LOW-DENSITY LIPOPROTE | 20.7 |
| 409041 | AB033025 | Hs. 50081 | KIAA1199 protein | 20.6 |
| 421305 | BE397354 | Hs. 289721 | diptheria toxin resistance protein required f | 20.6 |
| 411704 | AI499220 | Hs. 71573 | hypothetical protein FLJ10074 | 20.5 |
| 417018 | M16038 | Hs. 80887 | v-yes-1 Yamaguchi sarcoma viral related oncog | 20.5 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 432827 | Z68128 | Hs. 3109 | Rho GTPase activating protein 4 | 20.4 |
| 410174 | AA306007 | Hs. 59461 | DKFZP434C245 protein | 20.4 |
| 425184 | BE278288 | Hs. 155048 | Lutheran blood group (Auberger b antigen incl | 20.4 |
| 452322 | BE566343 | Hs. 28988 | glutaredoxin (thioltransferase) | 20.3 |
| 447526 | AL048753 | Hs. 340 | small inducible cytokine A2 (monocyte chemota | 20.2 |
| 447335 | BE617695 | Hs. 286192 | protein phosphatase 1, regulatory (inhibitor) | 20.2 |
| 424867 | AI024860 | Hs. 153591 | Not56 (D melanogaster)-like protein | 20.1 |
| 410275 | U85658 | Hs. 61796 | transcription factor AP-2 gamma (activating e | 20.1 |
| 429083 | Y09397 | Hs. 227817 | BCL2-related protein A1 | 20.0 |
| 410173 | AA706017 | Hs. 119944 | ESTs | 19.8 |
| 433047 | M86135 | Hs. 279946 | methionine-tRNA synthetase | 19.8 |
| 419088 | AI538323 | Hs. 77496 | ESTs | 19.7 |
| 403381 | | | 0 | 19.6 |
| 409162 | H25530 | Hs. 50868 | solute carrier family 22 (organic cation tran | 19.5 |
| 426150 | NM_003658 | Hs. 167218 | BarH-like homeobox 2 | 19.4 |
| 449292 | AI990292 | Hs. 225457 | ESTs | 19.4 |
| 425207 | AB014551 | Hs. 155120 | rho/rac guanine nucleotide exchange factor (G | 19.4 |
| 419950 | AK001645 | Hs. 93871 | hypothetical protein FLJ10783 | 19.3 |
| 436481 | AA379597 | Hs. 5199 | HSPC150 protein similar to ubiquitin-conjugat | 19.3 |
| 445930 | AF055009 | Hs. 13456 | *Homo sapiens* clone 24747 mRNA sequence | 19.2 |
| 446608 | N75217 | Hs. 257846 | ESTs | 19.1 |
| 425222 | M85430 | Hs. 155191 | villin 2 (eznn) | 19.1 |
| 428309 | M97815 | Hs. 183650 | cellular retinoic acid-binding protein 2 | 19.1 |
| 420005 | AW271106 | Hs. 133294 | ESTs | 19.1 |
| 436982 | AB018305 | Hs. 5378 | spondin 1, (f-spondin) estracellular matrix p | 19.0 |
| 407142 | AA412535 | Hs. 55235 | sphingomyelin phosphodiesterase 2, neutral me | 19.0 |
| 430122 | NM_013342 | Hs. 233765 | TCF3 (E2A) fusion partner (in childhood Leuke | 18.9 |
| 446293 | AI420213 | Hs. 149722 | ESTs | 18.9 |
| 444825 | AW167613 | Hs. 248 | mitogen-activated protein kinase kinase kinas | 18.9 |
| 407634 | AW016569 | Hs. 301280 | UDP-GlcNAc: betaGal beta-1,3-N-acetylglucosami | 18.9 |
| 445200 | AA084460 | Hs. 12409 | somatoatatin | 18.9 |
| 418917 | X02994 | Hs. 1217 | adenosine deaminase | 18.8 |
| 435777 | AW419202 | Hs. 286192 | protein phosphatase 1, regulatory (inhibitor) | 18.8 |
| 431049 | AA846576 | Hs. 103267 | hypothetical protein FLJ22548 similar to gene | 18.7 |
| 426427 | M86699 | Hs. 169840 | TTK protein kinase | 18.7 |
| 436281 | AW411194 | Hs. 120051 | ESTs | 18.6 |
| 425907 | AA365752 | Hs. 155965 | ESTs | 18.6 |
| 459720 | | | ESTs | 18.6 |
| 421242 | AW161386 | Hs. 13561 | ESTs, Weakly similar to dJ37E165 [*H. sapiens*] | 18.5 |
| 457715 | AA642402 | Hs. 59142 | ESTs | 18.5 |
| 451668 | Z43948 | Hs. 26789 | ASPIC (acidic secreted protein in cartilage)A | 18.4 |
| 437142 | AI791617 | Hs. 145068 | ESTs | 18.4 |
| 418588 | BE387040 | Hs. 182476 | ESTs, Weakly similar to similar to alpha/beta | 18.3 |
| 433068 | NM_006456 | Hs. 288215 | sialyltransferase | 18.3 |
| 419854 | AW664873 | Hs. 87836 | *Homo sapiens* PAC clone RP5-1087M19 from 7q11 | 18.3 |
| 444726 | NM_006147 | Hs. 11801 | interferon regulatory factor 6 | 18.3 |
| 423011 | NM_000683 | Hs. 299847 | ESTs, Highly similar to A2AD_HUMAN ALPHA-2C-2 | 18.2 |
| 451428 | AW083384 | Hs. 11067 | ESTs, Weakly similar to K02E10.2 [*C. elegans*] | 18.2 |
| 424865 | AF011333 | Hs. 153563 | lymphocyte antigen 75 | 18.2 |
| 418742 | AW451197 | Hs. 113418 | ESTs | 18.1 |
| 446627 | AI973016 | Hs. 15725 | ESTs; hypothetical protein SBBI48 | 18.1 |
| 424885 | AI333771 | Hs. 82204 | ESTs | 18.1 |
| 402926 | | | 0 | 18.0 |
| 405452 | | | 0 | 18.0 |
| 428641 | AA431367 | Hs. 234546 | GMPR2 for guanosine monophosphate reductase $$ | 18.0 |
| 454390 | AB020713 | Hs. 56966 | KIAA0906 protein | 18.0 |
| 441784 | AI522132 | Hs. 28700 | ESTs | 18.0 |
| 418758 | AW959311 | Hs. 87019 | ESTs | 17.9 |
| 408621 | AI970672 | Hs. 46638 | chromosome 11 open reading frame 8, fetal br | 17.9 |
| 426201 | AW182614 | Hs. 128499 | ESTs | 17.8 |
| 410442 | X73424 | Hs. 63788 | propionyl Coenzyme A carboxylase, beta polype | 17.8 |
| 456423 | AW748920 | | gb: CM2-BT0306-171199-034-g02 BT0306 Homo sapi | 17.8 |
| 422867 | L32137 | Hs. 1584 | cartilage oligomeric matrix protein | 17.8 |
| 448110 | AA626937 | Hs. 181551 | ESTs | 17.7 |
| 421750 | AK000768 | Hs. 107872 | hypothetical protein FLJ20761 | 17.7 |
| 405224 | | | 0 | 17.7 |
| 447630 | AI660149 | Hs. 44865 | lymphoid enhancer-binding factor 1 | 17.7 |
| 407663 | NM_016429 | Hs. 37482 | COPZ2 for nonclathrin coat protein zeta-COP | 17.7 |
| 427490 | Z95152 | Hs. 178695 | mitogen-activated protein kinase 13 | 17.6 |
| 414812 | X72755 | Hs. 77367 | monokine induced by gamma interferon | 17.6 |
| 427691 | AW194426 | Hs. 20726 | ESTs | 17.6 |
| 420650 | AA455706 | Hs. 44581 | heat shock protein hap70-related protein | 17.5 |
| 439841 | AF038961 | Hs. 6710 | mannose-P-dolichol utilization defect 1 | 17.5 |
| 425810 | AI923627 | Hs. 31903 | ESTs | 17.5 |
| 425397 | J04088 | Hs. 156346 | topoisomerase (DNA) II alpha (170 kD) | 17.5 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 456098 | AW747800 | Hs. 55016 | hypothetical protein FLJ21935 | 17.4 |
| 428579 | NM_005756 | Hs. 184942 | G protein-coupled receptor 64 | 17.4 |
| 410361 | BE391804 | Hs. 62661 | guanylate binding protein 1, interferon-induc | 17.4 |
| 442402 | NM_000954 | Hs. 8272 | prostaglandin D2 synthase (21 kD, brain) | 17.4 |
| 411734 | AW374954 | Hs. 71779 | Homo sapiens DNA from chromosome 19, cosmid F | 17.3 |
| 405295 | | | 0 | 17.3 |
| 408340 | AB037762 | Hs. 44268 | myelin gene expression factor 2 | 17.3 |
| 456068 | AI677897 | Hs. 76640 | RGC32 protein | 17.3 |
| 448571 | AA486794 | Hs. 66915 | ESTs, Weakly similar to 16.7 Kd protein [H.sap | 17.2 |
| 441829 | AL117482 | Hs. 7978 | DKFZP434C131 protein | 17.2 |
| 418004 | U37519 | Hs. 87539 | aldehyde dehydrogenase 8 | 17.2 |
| 412078 | X69699 | Hs. 73149 | paired box gene 8 | 17.2 |
| 414658 | X58528 | Hs. 76781 | ATP-binding cassette, sub-family D (ALD), mem | 17.1 |
| 418478 | U38945 | Hs. 1174 | cyclin-dependent kinase inhibitor 2A (melanom | 17.0 |
| 426805 | AB032945 | Hs. 172506 | myosin VB | 17.0 |
| 410247 | AF181721 | Hs. 61345 | RU2S | 17.0 |
| 434516 | AA807814 | Hs. 70582 | ESTs, Moderately similar to AF144056 1 apopto | 16.9 |
| 428153 | AW513143 | Hs. 98367 | hypothetical protein FLJ22252 similar to SRY- | 16.9 |
| 417793 | AW405434 | Hs. 82575 | small nuclear ribonucleoprotein polypeptide B | 16.9 |
| 454163 | AW175997 | | gb: QV0-BT0078-190899-005-E02 BT0078 Homo sapi | 16.9 |
| 415402 | AA164687 | Hs. 297889 | ESTs | 16.9 |
| 420309 | AW043637 | Hs. 21766 | ESTs | 16.9 |
| 419201 | M22324 | Hs. 1239 | alanyl (membrane) aminopeptidase (aminopeptid | 16.9 |
| 444391 | AL137597 | Hs. 11114 | hypothetical protein dJ1181N3 1 | 16.9 |
| 457705 | AW974668 | | gb: EST386757 MAGE resequences, MAGM Homo sapi | 16.8 |
| 412723 | AA648459 | Hs. 179912 | ESTs | 16.8 |
| 435774 | R88066 | Hs. 4992 | tumor suppressing subtransferable candidate 1 | 16.8 |
| 408753 | AI337192 | Hs. 47438 | SH3 domain binding glutamic acid-rich protein | 16.8 |
| 447783 | AF054178 | Hs. 19561 | NADH dehydrogenase (ubiquinone) 1 alpha subco | 16.8 |
| 418085 | R40328 | Hs. 258822 | ESTs | 16.7 |
| 452472 | AW957300 | Hs. 294142 | ESTs, Weakly similar to SP49_HUMAN SPLICEOSOM | 16.7 |
| 409112 | BE243971 | Hs. 50649 | quinone oxidoreductase homolog | 16.7 |
| 410250 | AI082777 | Hs. 61384 | KIAA1445 protein | 16.7 |
| 446219 | AI287344 | Hs. 149827 | ESTs | 16.6 |
| 428928 | BE409838 | Hs. 194657 | cadherin 1, type 1, E-cadherin (epithelial) | 16.6 |
| 425812 | AA364128 | Hs. 245633 | ESTs | 16.6 |
| 411742 | AW247593 | Hs. 71819 | eukaryotic translation initiation factor 4E b | 16.6 |
| 415076 | NM_000857 | Hs. 77890 | guanylate cyclase 1, soluble, beta 3 | 16.6 |
| 416209 | AA236776 | Hs. 79078 | MAD2 (mitotic arrest deficient, yeast, homolo | 16.6 |
| 440667 | BE076969 | Hs. 7337 | hypothetical protein FLJ10936 | 16.6 |
| 430375 | AW371048 | Hs. 93758 | H4 histone family, member H | 16.6 |
| 419607 | R52557 | Hs. 91579 | Homo sapiens clone 23783 mRNA sequence | 16.6 |
| 410328 | BE080190 | Hs. 62275 | CGI-141 protein | 16.5 |
| 405426 | | | 0 | 16.5 |
| 432636 | AA340864 | Hs. 278562 | claudin 7 | 16.5 |
| 434725 | AK000796 | Hs. 4104 | hypothetical protein | 16.5 |
| 414683 | S78296 | Hs. 76888 | internexin neuronal intermediate filament pro | 16.5 |
| 429500 | X78565 | Hs. 289114 | hexabrachion (tenascin C, cytotactin) | 16.5 |
| 449944 | AF290512 | Hs. 58215 | Homo sapiens rhotekin mRNA, partial cds | 16.4 |
| 400666 | | | 0 | 16.4 |
| 421536 | BE250690 | Hs. 105509 | CTL2 gene | 16.4 |
| 436032 | AA150797 | Hs. 109276 | latexin protein | 16.4 |
| 418196 | AI745649 | Hs. 26549 | ESTs, Weakly similar to T00066 hypothetical p | 16.4 |
| 452323 | AW44356 | Hs. 292812 | ESTs, Weakly similar to C43H8 1 [C. elegans] | 16.4 |
| 407699 | AA825974 | Hs. 32646 | Homo sapiens cDNA FLJ21901 fis, clone HEP034 | 16.4 |
| 414617 | AI339520 | Hs. 20524 | ESTs, Moderately similar to hexokinase I [H.s | 16.3 |
| 408204 | AA454501 | Hs. 43666 | protein tyrosine phosphatase type IVA, member | 16.3 |
| 452650 | AW270150 | Hs. 254516 | ESTs | 16.3 |
| 432906 | BE265489 | Hs. 3123 | lethal giant larvae (Drosophila) homolog 2 | 16.3 |
| 402408 | | | 0 | 16.3 |
| 408805 | H69912 | Hs. 48269 | vaccinia related kinase 1 | 16.3 |
| 447155 | AA100605 | Hs. 121557 | ESTs, Weakly similar to AF251041 1 SGC32445 p | 16.3 |
| 405699 | | | 0 | 16.2 |
| 406893 | M22406 | | gb: Human intestinal mucin mRNA, partial cds, | 16.2 |
| 418629 | BE247550 | Hs. 86859 | growth factor receptor-bound protein 7 (GRB7) | 16.2 |
| 424905 | NM_002497 | Hs. 153704 | NIMA (never in mitosis gene a)-related kinase | 16.2 |
| 424243 | AI949359 | Hs. 301837 | ESTs, Highly similar to cis Golgi-localized c | 16.2 |
| 418462 | BE001596 | Hs. 85266 | integrin, beta 4 | 16.1 |
| 457205 | AI905780 | Hs. 198272 | NADH dehydrogenase (ubiquinone) 1 beta subcom | 16.1 |
| 428188 | M98447 | Hs. 22 | transglutaminase 1 (K polypeptide epidermal t | 16.1 |
| 449845 | AW971183 | Hs. 60054 | ESTs | 16.1 |
| 406429 | | | 0 | 16.1 |
| 407375 | AA091354 | | gb: II0815.seq.F Human fetal heart, Lambda ZAP | 16.1 |
| 448377 | AI494514 | Hs. 171380 | ESTs | 16.1 |
| 431156 | NM_002220 | Hs. 2722 | inositol 1,4,5-trisphosphate 3-kinase A | 16.0 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 450043 | AA885699 | Hs. 24332 | CGI-26 protein | 16.0 |
| 403121 | | | 0 | 16.0 |
| 400214 | | | 0 | 15.9 |
| 453252 | R02436 | Hs. 215725 | ESTs | 15.9 |
| 451734 | NM_006176 | Hs. 26944 | neurogranin (protein kinase C substrate, RC3) | 15.9 |
| 416855 | AA188763 | Hs. 36793 | Homo sapiens cDNA: FLJ23188 fis, clone LNG120 | 15.9 |
| 424474 | AA308883 | Hs. 148680 | calcyon, D1 dopamine receptor-interacting pro | 15.9 |
| 423685 | BE350494 | Hs. 49753 | Homo sapiens mRNA for KIAA1561 protein, parti | 15.9 |
| 428187 | AI687303 | Hs. 285529 | ESTs | 15.9 |
| 438817 | AI023799 | Hs. 163242 | ESTs | 15.9 |
| 425692 | D90041 | Hs. 155956 | NAT1, arylamine N-acetyltransferase | 15.9 |
| 421674 | T10707 | Hs. 296355 | neuronal PAS domain protein 2 | 15.9 |
| 439999 | AA115811 | Hs. 6838 | ras homolog gene family, member E | 15.9 |
| 411351 | W02919 | Hs. 283476 | peroxisomal acyl-CoA thioesterase | 15.9 |
| 413027 | NM_002885 | Hs. 75151 | RAP1, GTPase activating protein 1 | 15.9 |
| 453884 | AA355925 | Hs. 36232 | KIAA0186 gene product | 15.8 |
| 407894 | AJ278313 | Hs. 41143 | phosphoinositide-specific phospholipase C-bet | 15.8 |
| 422748 | AA316266 | Hs. 129349 | ESTs | 15.8 |
| 414591 | AI888490 | Hs. 55902 | ESTs | 15.8 |
| 421877 | AW250380 | Hs. 109059 | mitochondrial ribosomal protein L12 | 15.8 |
| 404780 | | | 0 | 15.8 |
| 401192 | | | 0 | 15.8 |
| 447519 | U46258 | Hs. 23448 | ESTs | 15.8 |
| 434262 | AF121858 | Hs. 12169 | sorting nexin 8 | 15.7 |
| 451253 | H48299 | Hs. 26126 | claudin 10 | 15.7 |
| 435499 | R89344 | Hs. 14148 | ESTs | 15.7 |
| 422424 | AI186431 | Hs. 116577 | prostate differentiation factor; placental bo | 15.7 |
| 424834 | AK001432 | Hs. 153408 | Homo sapiens cDNA: FLJ10570 fis, clone NT2RP20 | 15.7 |
| 424562 | AI420859 | Hs. 150557 | basic transcription element binding protein 1 | 15.7 |
| 443247 | BE614387 | Hs. 47378 | ESTs | 15.7 |
| 430696 | AA531276 | Hs. 59509 | ESTs | 15.6 |
| 437044 | AL035864 | Hs. 69517 | ESTs, highly similar to differentially expres | 15.6 |
| 428237 | AF175206 | Hs. 183125 | killer cell lectin-like receptor F1 | 15.6 |
| 440048 | AA897461 | Hs. 158469 | ESTs, Weakly similar to envelope protein [H.s | 15.6 |
| 414922 | D00723 | Hs. 77631 | glycine cleavage system protein H (aminomethy | 15.6 |
| 422030 | X51416 | Hs. 110849 | estrogen-related receptor alpha | 15.6 |
| 408716 | AI567839 | Hs. 151714 | ESTs | 15.5 |
| 410258 | X52638 | Hs. 739 | 6-phosphofructo-2-kinase/fructose-2,6-biphosp | 15.5 |
| 410530 | M25809 | Hs. 64173 | ESTs, Highly similar to VAB1_HUMAN VACUOLAR A | 15.5 |
| 447072 | D61594 | Hs. 17279 | tyrosylprotein sulfotransferase 1 | 15.5 |
| 409015 | BE389387 | Hs. 49767 | NADH dehydrogenase (ubiquinone) Fe-S protein | 15.5 |
| 447549 | AI871120 | Hs. 231265 | ESTs | 15.5 |
| 449704 | AK000733 | Hs. 23900 | GTPase activating protein | 15.4 |
| 427337 | Z46223 | Hs. 176663 | Fc fragment of IgG, low affinity IIIb, recept | 15.4 |
| 421630 | NM_001956 | Hs. 1407 | endothelin 2 | 15.4 |
| 433018 | AI669760 | Hs. 188881 | ESTs | 15.4 |
| 422938 | NM_001809 | Hs. 1594 | centromere protein A (17 kD) | 15.3 |
| 407014 | U38268 | | gb: Human cytochrome b pseudogene, partial cds | 15.2 |
| 429311 | AF080157 | Hs. 198998 | conserved helix-loop-helix ubiquitous kinase | 15.2 |
| 431842 | NM_005764 | Hs. 271473 | epithelial protein up-regulated in carcinoma, | 15.2 |
| 406907 | Z25427 | | gb: H. Sapiens protein-serine/threonine kinase | 15.2 |
| 458495 | AI202029 | Hs. 148593 | ESTs | 15.2 |
| 420551 | AL137692 | Hs. 98790 | Homo sapiens mRNA, cDNA DKFZp434P182 (from cl | 15.1 |
| 448443 | AW167128 | Hs. 231934 | ESTs | 15.1 |
| 443646 | AI085198 | Hs. 298699 | ESTs | 15.1 |
| 431538 | AL137547 | Hs. 259619 | Homo sapiens mRNA; cDNA DKFZp434B1120 (from c | 15.1 |
| 436687 | AA868643 | Hs. 120461 | ESTs | 15.1 |
| 420917 | AW135716 | Hs. 117330 | ESTs | 15.0 |
| 428575 | M19684 | Hs. 184929 | serine (or cysteine) proteinase inhibitor, cl | 15.0 |
| 403482 | | | 0 | 15.0 |
| 421499 | AI271438 | Hs. 105022 | Homo sapiens PAC clone RP4-701O16 from 7q33-q | 15.0 |
| 401047 | | | 0 | 14.9 |
| 417749 | U09196 | Hs. 82520 | polymerase (DNA-directed), delta 4 | 14.9 |
| 416693 | AI373204 | Hs. 79531 | Homo sapiens TTF-I interacting peptide 20 mRN | 14.9 |
| 428474 | AB023182 | Hs. 184523 | KIAA0965 protein | 14.9 |
| 428862 | NM_000346 | Hs. 2316 | SRY (sex-determining region Y)-box 9 (campome | 14.9 |
| 430271 | T06199 | Hs. 237506 | heat shock cognate 40 | 14.9 |
| 414328 | Z21666 | Hs. 75900 | aconitase 2, mitochondrial | 14.9 |
| 415314 | N88802 | Hs. 5422 | glycoprotein M6B | 14.8 |
| 453735 | AI066629 | Hs. 125073 | ESTs | 14.8 |
| 424345 | AK001380 | Hs. 145479 | Homo sapiens cDNA: FLJ10518 fis, clone NT2RP20 | 14.8 |
| 423575 | C18863 | Hs. 163443 | ESTs | 14.8 |
| 438081 | H49546 | Hs. 298964 | ESTs | 14.8 |
| 403485 | | | 0 | 14.8 |
| 452114 | N22687 | Hs. 8236 | ESTs | 14.8 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 426559 | AB001914 | Hs. 170414 | paired basic amino acid cleaving system 4 | 14.8 |
| 412869 | AA290712 | Hs. 82407 | *Homo sapiens* HSPC296 mRNA, partial cds | 14.8 |
| 452101 | T60298 | | gb: yb87f12.r1 Stratagene liver (937224) Homo | 14.7 |
| 420505 | AW967984 | Hs. 291612 | ESTs | 14.7 |
| 426125 | X87241 | Hs. 166994 | FAT tumor suppressor (Drosophila) homolog | 14.7 |
| 433336 | AF017986 | Hs. 31386 | ESTs; Highly similar to FRIZZLED PROTEIN PRE | 14.7 |
| 428977 | AK001404 | Hs. 194698 | cyclin B2 | 14.7 |
| 429785 | H82114 | Hs. 301769 | ESTs | 14.7 |
| 402424 | | | 0 | 14.7 |
| 424971 | AA479005 | Hs. 154036 | tumor suppressing subtransferable candidate 3 | 14.7 |
| 433037 | NM_014158 | Hs. 279938 | HSPC067 protein | 14.6 |
| 421670 | BE207318 | Hs. 106674 | BRCA1 associated protein-1 (ubiquitin carboxy | 14.6 |
| 438598 | AI805943 | Hs. 5723 | *Homo sapiens* cDNA: FLJ23439 fis, clone HSI001 | 14.6 |
| 453370 | AI470523 | Hs. 182356 | ESTs, Moderately similar to translation initi | 14.6 |
| 410561 | BE540255 | Hs. 6994 | *Homo sapiens* cDNA: FLJ22044 fis, clone HEP091 | 14.6 |
| 402287 | | | 0 | 14.6 |
| 419741 | NM_007019 | Hs. 93002 | ubiquitin carrier protein E2-C | 14.6 |
| 442047 | AA974598 | Hs. 150324 | ESTs | 14.5 |
| 428582 | BE336699 | Hs. 185055 | BENE protein | 14.5 |
| 440006 | AK000517 | Hs. 6844 | hypothetical protein FLJ20510 | 14.5 |
| 406851 | AA609784 | Hs. 180255 | major histocompatibility complex, class II, D | 14.5 |
| 457316 | AI123657 | Hs. 127264 | ESTs | 14.5 |
| 420453 | AL157500 | Hs. 97840 | *Homo sapiens* mRNA; cDNA DKFZp434G015 (from cl | 14.5 |
| 436406 | AW105723 | Hs. 125346 | ESTs | 14.5 |
| 420736 | AI263022 | Hs. 82204 | ESTs | 14.5 |
| 419743 | AW408762 | Hs. 127478 | ESTs | 14.5 |
| 429113 | D28235 | Hs. 196384 | Prostaglandin-endoperoxide synthase 2 (COX-2) | 14.5 |
| 450256 | AA286887 | Hs. 24724 | MFH-amplified sequences with leucine-rich tan | 14.5 |
| 424906 | AI566086 | Hs. 153716 | *Homo sapiens* mRNA for Hmob33 protein, 3' untr | 14.5 |
| 427414 | F11750 | Hs. 6647 | *Homo sapiens* cDNA: FLJ13088 fis, clone NT2RP30 | 14.4 |
| 419839 | U24577 | Hs. 93304 | phospholipase A2, group VII (platelet-activat | 14.4 |
| 418738 | AW388633 | Hs. 6682 | solute carrier family 7, member 11 | 14.3 |
| 429414 | AI783656 | Hs. 202095 | empty spiracles (Drosophila) homolog 2 | 14.3 |
| 424669 | AA417181 | Hs. 120858 | *Homo sapiens* cDNA: FLJ13945 fis, clone Y79AA10 | 14.3 |
| 408989 | AW361666 | Hs. 49500 | KIAA0746 protein | 14.3 |
| 406788 | AI911841 | Hs. 5184 | TH1 drosophila homolog | 14.3 |
| 417861 | AA334551 | Hs. 82767 | sperm specific antigen 2 | 14.3 |
| 402104 | | | 0 | 14.3 |
| 416368 | R88849 | | gb: ym96a06.r1 Soares adult brain N2b4HB55Y Ho | 14.2 |
| 405802 | | | 0 | 14.2 |
| 448357 | N20169 | Hs. 108923 | ESTs | 14.2 |
| 444261 | AA298958 | Hs. 10724 | MDS023 protein | 14.2 |
| 407846 | AA426202 | Hs. 40403 | Cbp/p300-interacting transactivator, with Glu | 14.2 |
| 425163 | D10040 | Hs. 154890 | fatty-acid-Coenzyme A ligase, long-chain 2 | 14.1 |
| 402520 | | | 0 | 14.1 |
| 429597 | NM_003816 | Hs. 2442 | a disintegrin and metalloproteinase domain 9 | 14.1 |
| 430044 | AA464510 | Hs. 152812 | EST cluster (not in UniGene) | 14.1 |
| 429663 | M68874 | Hs. 211587 | Human phosphatidylcholine 2-acylhydrolase (cP | 14.1 |
| 427036 | AA397625 | Hs. 163913 | ESTs | 14.1 |
| 444381 | BE387335 | Hs. 283713 | ESTs | 14.1 |
| 432090 | AW972855 | Hs. 292853 | ESTs | 14.0 |
| 406778 | H06273 | Hs. 101651 | *Homo sapiens* mRNA; cDNA DKFZp434C107 (from cl | 14.0 |
| 404961 | AW972195 | Hs. 284236 | aldo-keto reductase family 7, member A3 (afla | 14.0 |
| 452313 | Y00486 | Hs. 28914 | adenine phosphoribosyltransferase | 14.0 |
| 452355 | N54926 | Hs. 29202 | G protein-coupled receptor 34 | 14.0 |
| 429942 | AI338993 | Hs. 134535 | ESTs | 14.0 |
| 403165 | | | 0 | 13.9 |
| 442150 | AI368158 | Hs. 128864 | ESTs | 13.9 |
| 439709 | AW401433 | Hs. 6649 | hypothetical protein FLJ20128 | 13.9 |
| 456799 | AC004923 | Hs. 135187 | *Homo sapiens* clone CDABP0025 mRNA sequence | 13.9 |
| 427356 | AW023482 | Hs. 97849 | ESTs | 13.9 |
| 448982 | AI638164 | Hs. 225520 | ESTs | 13.9 |
| 432025 | BE407132 | Hs. 111286 | hypothetical protein FLJ22512 | 13.8 |
| 427505 | AA361562 | Hs. 178761 | 26S proteasome-associated pad1 homolog | 13.8 |
| 402965 | | | 0 | 13.8 |
| 418601 | AA279490 | Hs. 86368 | calmegin | 13.8 |
| 436954 | AA740151 | Hs. 130425 | ESTs | 13.8 |
| 405024 | | | 0 | 13.8 |
| 453976 | BE463830 | Hs. 163714 | ESTs | 13.8 |
| 431921 | N46466 | Hs. 58879 | ESTs | 13.8 |
| 401735 | | | 0 | 13.8 |
| 445496 | AB007860 | Hs. 12802 | development and differentiation enhancing fac | 13.8 |
| 425007 | AA456483 | Hs. 172081 | phosphodiesterase 4D, cAMP-specific (dunce (D | 13.7 |
| 409463 | AI458165 | Hs. 17296 | ESTs | 13.7 |
| 430193 | AI826653 | Hs. 102928 | *Homo sapiens* cDNA: FLJ13479 fis, clone PLACE10 | 13.7 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 458869 | AI637934 | Hs. 224978 | ESTs | 13.7 |
| 426769 | AA075596 | Hs. 172153 | glutathione peroxidase 3 (plasma) | 13.7 |
| 416661 | AA634543 | Hs. 79440 | IGF-ll mRNA-binding protein 3 | 13.7 |
| 439901 | N73885 | Hs. 124169 | ESTs | 13.7 |
| 431374 | BE258532 | Hs. 251871 | CTP synthase | 13.7 |
| 432861 | AA339526 | Hs. 279593 | HSPC171 protein | 13.7 |
| 441172 | AI279652 | Hs. 132879 | ESTs | 13.7 |
| 410001 | AB041036 | Hs. 57771 | kallikrein 11, serine protease (TLSP) | 13.7 |
| 430315 | NM_004293 | Hs. 239147 | guanine deaminase | 13.6 |
| 422769 | AA938905 | Hs. 289112 | CGI-43 protein | 13.6 |
| 402389 | | | 0 | 13.6 |
| 448977 | X91809 | Hs. 22698 | regulator of G-protein signalling 19 | 13.6 |
| 459648 | | | gb: IL3-CT0220-150200-070-B02 CT0220 Homo sapi | 13.6 |
| 452972 | M31732 | Hs. 31210 | B-cell CLL/lymphoma 3 | 13.6 |
| 431441 | U81961 | Hs. 2794 | sodium channel, nonvoltage-gated 1 alpha | 13.6 |
| 448585 | AB020676 | Hs. 21543 | KIAA0869 protein | 13.6 |
| 428385 | AF112213 | Hs. 184062 | putative Rab5-interacting protein | 13.6 |
| 434699 | AA643687 | Hs. 149425 | *Homo sapiens* cDNA: FLJ11980 fis, clone HEMBB10 | 13.6 |
| 447238 | AW451676 | Hs. 158564 | ESTs | 13.6 |
| 437108 | AA434054 | Hs. 80624 | *Homo sapiens* cDNA: FLJ23442 fis, clone HSI009 | 13.6 |
| 425749 | AW328587 | Hs. 159448 | surfeit 2 | 13.5 |
| 425154 | NM_001851 | Hs. 154850 | collagen, type IX, alpha 1 | 13.5 |
| 413753 | U17760 | Hs. 301103 | Laminin, beta 3 (nicein (125 kD), kalinin (140 | 13.5 |
| 419034 | NM_002110 | Hs. 89555 | hemopoietic cell kinase | 13.5 |
| 448361 | H82028 | Hs. 238707 | *Homo sapiens* cDNA: FLJ22457 fis, clone HRC099 | 13.5 |
| 412754 | AW160375 | Hs. 74565 | amyloid beta (A4) precursor-like protein 1 | 13.5 |
| 419081 | AI798863 | Hs. 87191 | ESTs | 13.5 |
| 407732 | AW138839 | Hs. 24210 | ESTs | 13.5 |
| 423329 | AF054910 | Hs. 127111 | tektin 2 (testicular) | 13.5 |
| 422627 | BE336857 | Hs. 118787 | transforming growth factor, beta-induced, 68 k | 13.4 |
| 439636 | AF086467 | | gb: *Homo sapiens* full length insert cDNA clone | 13.4 |
| 417605 | AF006609 | Hs. 82294 | regulator of G-protein signalling 3 | 13.4 |
| 445861 | BE293423 | Hs. 11809 | single Ig IL-1R-related molecule | 13.4 |
| 447350 | AI375572 | Hs. 172634 | ESTs, HER4 (c-erb-B4) | 13.4 |
| 451807 | W52854 | Hs. 27099 | DKFZP564J0863 protein | 13.4 |
| 421515 | Y11339 | Hs. 105352 | GalNAc alpha-2, 6-sialyltransferase I, long f | 13.4 |
| 422443 | NM_014707 | Hs. 116753 | histone deacetylase 7B | 13.4 |
| 412504 | Z44496 | Hs. 26039 | *Homo sapiens* cDNA: FLJ13937 fis, clone Y79AA10 | 13.4 |
| 453344 | BE349075 | Hs. 44571 | ESTs | 13.4 |
| 402885 | | | 0 | 13.4 |
| 438712 | AW978161 | Hs. 169877 | ESTs | 13.4 |
| 421774 | AL050374 | Hs. 108169 | DKFZP586C1619 protein | 13.3 |
| 425638 | NM_012337 | Hs. 158450 | nasopharyngeal epithelium specific protein 1 | 13.3 |
| 401897 | | | 0 | 13.3 |
| 425601 | AW629485 | Hs. 293352 | ESTs | 13.3 |
| 450779 | AW204145 | Hs. 156044 | ESTs | 13.3 |
| 444858 | AI199738 | Hs. 208275 | ESTs, Weakly similar to unnamed protein produ | 13.3 |
| 442619 | AA447492 | Hs. 20183 | ESTs, Weakly similar to AF164793 1 protein x | 13.3 |
| 434263 | N34895 | Hs. 44648 | ESTs | 13.3 |
| 426059 | BE292842 | Hs. 166120 | interferon regulatory factor 7 | 13.3 |
| 407467 | D55638 | | gb: Human B-cell PABL (pseudoautosomal boundar | 13.3 |
| 412560 | R24601 | Hs. 108300 | CCR4-NOT transcription complex, subunit 3 | 13.2 |
| 442986 | AI025990 | Hs. 285520 | ESTs | 13.2 |
| 420317 | AB006628 | Hs. 96485 | KIAA0290 protein | 13.2 |
| 443211 | AI128388 | Hs. 143655 | ESTs | 13.2 |
| 434361 | AF129755 | Hs. 117772 | ESTs | 13.2 |
| 423493 | AI815965 | Hs. 129683 | ubiquitin-conjugating enzyme E2D 1 (homologou | 13.2 |
| 414183 | AW957446 | Hs. 301711 | ESTs | 13.2 |
| 447778 | BE620592 | Hs. 71190 | ESTs | 13.2 |
| 435106 | AA100847 | Hs. 193380 | ESTs, Highly similar to AF174600 1 F-box prot | 13.1 |
| 439490 | AW249197 | Hs. 100043 | ESTs, Weakly similar to PSF_HUMAN PTB-ASSOCIA | 13.1 |
| 409606 | AW444594 | Hs. 2387 | transglutaminase 4 (prostate) | 13.1 |
| 421308 | AA687322 | Hs. 192843 | ESTs | 13.1 |
| 414950 | C15407 | | gb: C15407 Clontech human aorta polyA+ mRNA (6 | 13.1 |
| 416783 | AA206186 | Hs. 79889 | monocyte to macrophage differentiation-associ | 13.1 |
| 415927 | AL120168 | Hs. 78919 | Kell blood group precursor (McLeod phenotype) | 13.1 |
| 422605 | H16646 | Hs. 118666 | Human clone 23759 mRNA, partial cds | 13.0 |
| 430427 | AA296701 | Hs. 241413 | opticin | 13.0 |
| 424620 | AA101043 | Hs. 151254 | kallikrein 7 (chymotryptic; stratum corneum) | 13.0 |
| 421693 | X71490 | Hs. 106876 | ATPase, H+ transporting, lysosomal (vacuolar | 13.0 |
| 407727 | AW411148 | Hs. 38044 | DKFZP564M082 protein | 13.0 |
| 427706 | AW971225 | Hs. 293800 | ESTs, Weakly similar to ALU1_HUMAN ALU SUBFAM | 13.0 |
| 406709 | AI355761 | Hs. 242463 | keratin 8 | 13.0 |
| 405353 | | | 0 | 13.0 |
| 453060 | AW294092 | Hs. 21594 | ESTs | 13.0 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 459299 | BE094291 | Hs. 155651 | hepatocyte nuclear factor 3, beta | 13.0 |
| 447843 | AW337186 | Hs. 224891 | ESTs | 13.0 |
| 446576 | AI659477 | Hs. 51820 | ESTs, Moderately similar to ALU7_HUMAN ALU SU | 13.0 |
| 449700 | L02867 | Hs. 78358 | ESTs | 13.0 |
| 436476 | AA326108 | Hs. 53631 | ESTs | 13.0 |
| 432532 | AW058459 | Hs. 162246 | ESTs | 13.0 |
| 408405 | AK001332 | Hs. 44672 | hypothetical protein FLJ10470 | 13.0 |
| 432673 | AB028859 | Hs. 278605 | ER-associated DNAJ, ER-associated Hsp40 co-ch | 12.9 |
| 414684 | AW630023 | Hs. 76893 | 3-hydroxybutyrate dehydrogenase (heart, mitoc | 12.9 |
| 447210 | AF035269 | Hs. 17752 | phosphatidylserine-specific phospholipase A1a | 12.9 |
| 427923 | AW274357 | Hs. 268384 | Fzr1 protein | 12.9 |
| 437395 | AL365408 | Hs. 10632 | hypothetical protein DKFZp762M136 | 12.9 |
| 441627 | AA947552 | Hs. 58086 | ESTs | 12.9 |
| 419084 | AA496539 | Hs. 179902 | transporter-like protein | 12.9 |
| 423067 | AA321355 | Hs. 285401 | ESTs | 12.9 |
| 423070 | R55677 | Hs. 155569 | ESTs | 12.8 |
| 441344 | BE250144 | Hs. 41514 | ESTs | 12.8 |
| 423527 | AI206965 | Hs. 105861 | *Homo sapiens* cDNA: FLJ13824 fis, clone THYRO10 | 12.8 |
| 417006 | AW673606 | Hs. 80758 | aspartyl-tRNA synthetase | 12.8 |
| 453552 | AL041941 | Hs. 154729 | 3-phosphoinositide dependent protein kinase-1 | 12.8 |
| 453657 | W23237 | Hs. 296162 | ESTs | 12.8 |
| 434414 | AI798376 |  | gb: tr34b07 x1 NCI_CGAP_Ov23 *Homo sapiens* cDNA | 12.7 |
| 456051 | T85626 | Hs. 76239 | hypothetical protein FLJ20608 | 12.7 |
| 451659 | BE379761 | Hs. 14248 | ESTs, Weakly similar to ALU8_HUMAN ALU SUBFAM | 12.7 |
| 418216 | AA662240 | Hs. 283099 | AF15q14 protein | 12.7 |
| 423281 | AJ271684 | Hs. 126355 | C-type (calcium dependent, carbohydrate-recog | 12.7 |
| 424275 | AW673173 | Hs. 144505 | DKFZP566F0546 protein | 12.7 |
| 440062 | AI350518 | Hs. 129692 | ESTs | 12.7 |
| 444371 | BE540274 | Hs. 239 | Forkhead box M1 | 12.7 |
| 412520 | AA442324 | Hs. 795 | H2A histone family, member O | 12.7 |
| 413349 | BE086692 |  | gb: QV1-BT0678-130400-156-g07 BT0678 Homo sapi | 12.7 |
| 414500 | W24087 | Hs. 76285 | DKFZP564B167 protein | 12.6 |
| 429261 | AW176254 | Hs. 143475 | ESTs | 12.6 |
| 402238 |  |  | 0 | 12.6 |
| 400280 |  |  | 0 | 12.6 |
| 421246 | AW582962 | Hs. 300961 | ESTs, Highly similar to AF151805 1 CGI-47 pro | 12.6 |
| 442029 | AW956698 | Hs. 14456 | neural precursor cell expressed, developmenta | 12.6 |
| 435502 | L13266 | Hs. 105 | glutamate receptor, ionotropic, N-methyl D-as | 12.6 |
| 409964 | AW368226 | Hs. 67928 | ESTs | 12.6 |
| 418793 | AW382987 | Hs. 88474 | prostaglandin-endoperoxide synthase 1 (prosta | 12.5 |
| 452117 | AI421760 | Hs. 77870 | *Homo sapiens* cDNA: FLJ12750 fis, clone NT2RP20 | 12.5 |
| 448074 | BE621355 | Hs. 27160 | ESTs | 12.5 |
| 442655 | AW027457 | Hs. 30323 | ESTs | 12.5 |
| 409928 | AL137163 | Hs. 57549 | hypothetical protein dJ473B4 | 12.5 |
| 400240 |  |  | 0 | 12.5 |
| 413048 | M93221 | Hs. 75182 | mannose receptor, C type 1 | 12.5 |
| 426215 | AW963419 | Hs. 155223 | ESTs | 12.5 |
| 430024 | AI808780 | Hs. 227730 | integrin, alpha 6 | 12.5 |
| 445655 | AA873830 | Hs. 167746 | B cell linker protein | 12.5 |
| 419941 | X98654 | Hs. 93837 | phosphatidylinositol transfer protein, membra | 12.5 |
| 425280 | U31519 | Hs. 1872 | phosphoenolpyruvate carboxykinase 1 (soluble) | 12.5 |
| 427767 | AI879283 | Hs. 180714 | cytochrome c oxidase subunit Via polypeptide | 12.4 |
| 450243 | AW119084 | Hs. 201037 | ESTs | 12.4 |
| 408930 | AA146721 | Hs. 49005 | hypothetical protein | 12.4 |
| 418783 | T41368 |  | gb: ph1d1_19/1TV Outward Alu-primed hncDNA lib | 12.4 |
| 452096 | BE394901 | Hs. 226785 | ESTs | 12.4 |
| 424513 | BE385864 | Hs. 149894 | mitochondrial translational initiation factor | 12.4 |
| 422306 | BE044325 | Hs. 227280 | *Homo sapiens* mRNA for Lsm5 protein | 12.4 |
| 409031 | AA376836 | Hs. 76728 | ESTs | 12.4 |
| 435515 | N40080 | Hs. 6879 | DC13 protein | 12.4 |
| 429583 | NM_006412 | Hs. 209119 | 1-acylglycerol-3-phosphate O-acyltransferase | 12.3 |
| 449643 | R05989 | Hs. 19603 | ESTs | 12.3 |
| 440313 | AL050060 | Hs. 7158 | DKFZP566H073 protein | 12.3 |
| 425593 | AA278921 | Hs. 1908 | proteoglycan 1, secretory granule | 12.3 |
| 447357 | AI375922 | Hs. 159367 | ESTs | 12.3 |
| 405089 |  |  | 0 | 12.3 |
| 414972 | BE263782 | Hs. 77695 | KIAA0008 gene product | 12.3 |
| 435039 | AW043921 | Hs. 130526 | ESTs | 12.3 |
| 447033 | AI357412 | Hs. 157601 | EST —not in UniGene | 12.3 |
| 427521 | AW973352 | Hs. 299056 | ESTs | 12.3 |
| 409377 | AA300274 | Hs. 115659 | *Homo sapiens* cDNA: FLJ23461 fis, clone HSI077 | 12.3 |
| 400116 |  |  | 0 | 12.3 |
| 445806 | AL137516 | Hs. 13323 | hypothetical protein FLJ22059 | 12.2 |
| 457817 | AA247751 | Hs. 79572 | cathepsin D (lysosomal aspartyl protease) | 12.2 |
| 442410 | AW996503 | Hs. 197680 | ESTs | 12.2 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 445404 | AI261687 | Hs. 145541 | ESTs, Weakly similar to JC4974 sodium iodide | 12.2 |
| 403372 | AW249152 | Hs. 44017 | SIR2 (silent mating type information regulati | 12.2 |
| 427082 | AB037858 | Hs. 173484 | hypothetical protein FLJ10337 | 12.2 |
| 433764 | AW753676 | Hs. 39982 | ESTs | 12.2 |
| 400268 | | | 0 | 12.2 |
| 433190 | M26901 | Hs. 3210 | renin | 12.2 |
| 444863 | AW384082 | Hs. 301323 | ESTs | 12.2 |
| 434779 | AF153815 | Hs. 50151 | potassium inwardly-rectifying channel, subfam | 12.2 |
| 451346 | NM_006338 | Hs. 26312 | glioma amplified on chromosome 1 protein (leu | 12.2 |
| 430262 | AA218780 | Hs. 237323 | N-acetylglucosamine-phosphate mutase | 12.2 |
| 421071 | AI311238 | Hs. 104476 | ESTs | 12.2 |
| 426773 | NM_015556 | Hs. 172180 | KIAA0440 protein | 12.1 |
| 409178 | BE393948 | Hs. 50915 | kallikrein 5 | 12.1 |
| 400250 | | | 0 | 12.1 |
| 428450 | NM_014791 | Hs. 184339 | KIAA0175 gene product | 12.1 |
| 414531 | T69387 | Hs. 76364 | allograft inflammatory factor 1 | 12.1 |
| 448210 | AW247775 | Hs. 7393 | hypothetical protein from EUROIMAGE 1987170 | 12.1 |
| 440081 | AA863389 | Hs. 135643 | ESTs | 12.1 |
| 413179 | N99692 | Hs. 75227 | NADH dehydrogenase (ubiquinone) 1 alpha Subco | 12.1 |
| 447551 | BE066634 | Hs. 929 | myosin, heavy polypeptide 7, cardiac muscle, | 12.1 |
| 400517 | AF242388 | Hs. 149585 | lengsin | 12.1 |
| 401610 | | | 0 | 12.0 |
| 454381 | AI935093 | Hs. 193428 | ESTs | 12.0 |
| 443997 | AW081465 | Hs. 299644 | ESTs | 12.0 |
| 402944 | | | 0 | 12.0 |
| 430637 | BE160081 | Hs. 256290 | S100 calcium-binding protein A11 (calgizzarin | 12.0 |
| 415099 | AI492170 | Hs. 77917 | ubiquitin carboxyl-terminal esterase L3 (ubiq | 12.0 |
| 445422 | AV653731 | Hs. 282829 | ESTs | 12.0 |
| 416667 | AK000526 | Hs. 79457 | hypothetical protein FLJ20519 | 12.0 |
| 442611 | BE077155 | Hs. 177537 | ESTs | 12.0 |
| 443271 | BE568568 | Hs. 195704 | ESTs | 12.0 |
| 415120 | N64464 | Hs. 34950 | ESTs | 12.0 |
| 439574 | AI469788 | Hs. 165190 | ESTs | 12.0 |
| 405804 | | | 0 | 12.0 |
| 412519 | AA196241 | Hs. 73980 | troponin T1, skeletal, slow | 12.0 |
| 414135 | NM_004419 | Hs. 2128 | dual specificity phosphatase 5 | 12.0 |
| 447075 | AV662037 | Hs. 124740 | ESTs | 12.0 |
| 416841 | N33878 | Hs. 249495 | heterogeneous nuclear ribonucleoprotein A1 | 12.0 |
| 402943 | | | 0 | 11.9 |
| 416933 | BE561850 | Hs. 80506 | small nuclear ribonucleoprotein polypeptide A | 11.9 |
| 439744 | AL389994 | Hs. 301272 | ESTs, Weakly similar to homologue of Drosphil | 11.9 |
| 405762 | | | 0 | 11.9 |
| 408983 | NM_000492 | Hs. 663 | cystic fibrosis transmembrane conductance reg | 11.9 |
| 455102 | BE005496 | | gb: CM1-BN0117-110400-183-b09 BN0117 Homo sapi | 11.9 |
| 402840 | | | 0 | 11.9 |
| 449183 | AW445022 | Hs. 196985 | *Homo sapiens* cDNA: FLJ21135 fis, clone CAS072 | 11.9 |
| 439273 | AW139099 | Hs. 269701 | ESTs | 11.9 |
| 450484 | BE220675 | | gb: ht98f11 x1 NCI_CGAP_Lu24 *Homo sapiens* cDNA: | 11.9 |
| 445431 | AF137386 | Hs. 12701 | plasmolipin | 11.9 |
| 401888 | | | 0 | 11.9 |
| 426037 | AW160780 | Hs. 166071 | cyclin-dependent kinase 5 | 11.9 |
| 416742 | R38644 | Hs. 248420 | ESTs | 11.9 |
| 418324 | AW246273 | Hs. 84131 | threonyl-tRNA synthetase | 11.8 |
| 412870 | N22788 | Hs. 82407 | *Homo sapiens* HSPC296 mRNA, partial cds | 11.8 |
| 432680 | T47364 | Hs. 278613 | interferon, alpha-inducible protein 27 | 11.8 |
| 421478 | AI683243 | Hs. 97258 | ESTs | 11.8 |
| 426635 | BE395109 | Hs. 129327 | ESTs | 11.8 |
| 420523 | AA262999 | Hs. 42788 | ESTs | 11.8 |
| 426227 | U67058 | Hs. 168102 | Human proteinase activated receptor-2 mRNA, 3 | 11.8 |
| 416658 | U03272 | Hs. 79432 | fibrillin 2 (congenital contractural arachnod | 11.8 |
| 441816 | AI401807 | Hs. 149997 | ESTs | 11.8 |
| 424596 | AB020639 | Hs. 151017 | estrogen-related receptor gamma | 11.8 |
| 400640 | | | 0 | 11.8 |
| 448133 | AA723157 | Hs. 73769 | folate receptor 1 (adult) | 11.8 |
| 401532 | | | 0 | 11.8 |
| 400161 | | | 0 | 11.8 |
| 442556 | AL137761 | Hs. 8379 | *Homo sapiens* mRNA, cDNA: DKFZp586L2424 (from c | 11.7 |
| 451002 | AA013299 | Hs. 8018 | ESTs, Weakly similar to ALU3_HUMAN ALU SUBFAM | 11.7 |
| 401879 | | | 0 | 11.7 |
| 415989 | AI267700 | Hs. 111128 | ESTs | 11.7 |
| 416434 | AW163045 | Hs. 79334 | nuclear factor, interleukin 3 regulated | 11.7 |
| 410616 | AW873401 | Hs. 273599 | ESTs | 11.7 |
| 449239 | T24653 | Hs. 23360 | likely ortholog of yeast ARV1 | 11.7 |
| 447669 | AL049985 | Hs. 19180 | *Homo sapiens* mRNA; cDNA: DKFZp564E122 (from cl | 11.7 |
| 436877 | AA931484 | Hs. 121255 | ESTs, Weakly similar to cDNA: EST EMBL: D67419 | 11.7 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 434560 | R13052 | Hs. 3964 | *Homo sapiens* clone 24877 mRNA sequence | 11.7 |
| 448105 | AW591433 | Hs. 170675 | ESTs, Weakly similar to TMS2_HUMAN TRANSMEMBR | 11.7 |
| 400279 | | | 0 | 11.6 |
| 440497 | AA887266 | Hs. 144979 | ESTs | 11.6 |
| 451260 | AW750773 | | gb: CM0-CN0044-260100-164-h03 CN0044 Homo sapi | 11.6 |
| 429175 | AI953040 | Hs. 127714 | ESTs, Moderately similar to SOX30 protein [H. | 11.6 |
| 408209 | NM_004454 | Hs. 43697 | ets variant gene 5 (ets-related molecule) | 11.6 |
| 428856 | AA436735 | Hs. 183171 | *Homo sapiens* cDNA FLJ22002 fis, clone HEP066 | 11.6 |
| 420153 | N22120 | Hs. 75277 | hypothetical protein FLJ13910 | 11.6 |
| 428760 | AI351459 | Hs. 192398 | ESTs | 11.6 |
| 421401 | AW410478 | Hs. 104019 | transforming, acidic coiled-coil containing p | 11.6 |
| 404502 | | | 0 | 11.6 |
| 430423 | AI190548 | Hs. 143479 | ESTs, Weakly similar to hypothetical protein | 11.6 |
| 405192 | | | 0 | 11.6 |
| 439092 | AA830149 | | gb: oc44f08 s1 NCI_CGAP_GCB1 *Homo sapiens* cDNA: | 11.6 |
| 401714 | | | 0 | 11.5 |
| 439335 | AA742697 | Hs. 62492 | ESTs, Weakly similar to S59856 collagen alpha | 11.5 |
| 406082 | S47833 | Hs. 82927 | adenosine monophosphate deaminase 2 (isoform | 11.5 |
| 401010 | | | 0 | 11.5 |
| 412140 | AA219691 | Hs. 73625 | RAB6 interacting, kinesin-like (rabkinesin6) | 11.5 |
| 409339 | AB020686 | Hs. 54037 | ectonucleotide pyrophosphatase/phosphodiester | 11.5 |
| 459684 | | | gb: ao86a08 x1 Schiller meningioma Homo sapien | 11.5 |
| 451051 | BE254309 | Hs. 125262 | DKFZP586G1624 protein | 11.5 |
| 415323 | BE269352 | Hs. 949 | neutrophil cytosolic factor 2 (65 kD, chronic | 11.5 |
| 412153 | R87934 | | gb: yo47b10 r1 Soares adult brain N2b4HB55Y Ho | 11.5 |
| 427256 | AL042436 | Hs. 97723 | ESTs | 11.5 |
| 406708 | AI282759 | Hs. 242463 | keratin 8 | 11.4 |
| 457644 | AA770080 | Hs. 144962 | ESTs, Moderately similar to I59365 ubiquitin | 11.4 |
| 422848 | Z25884 | Hs. 121483 | chloride channel 1, skeletal muscle (Thomsen | 11.4 |
| 424134 | AF070637 | Hs. 140950 | hypothetical protein | 11.4 |
| 451931 | AK000208 | Hs. 27267 | *Homo sapiens* cDNA: FLJ20201 fis, clone COLF121 | 11.4 |
| 400438 | AF185611 | Hs. 115352 | growth hormone 1 | 11.4 |
| 412994 | D32257 | Hs. 75113 | general transcription factor IIIA | 11.4 |
| 408124 | U89337 | Hs. 42853 | cAMP responsive element binding protein-like | 11.4 |
| 452249 | BE394412 | Hs. 61252 | ESTs | 11.4 |
| 424627 | AA344555 | | gb: EST50715 Gall bladder I *Homo sapiens* cDNA: | 11.4 |
| 405626 | | | 0 | 11.4 |
| 436690 | AA373970 | Hs. 183096 | ESTs | 11.4 |
| 415862 | R51034 | Hs. 144513 | ESTs | 11.4 |
| 406755 | N80129 | Hs. 94360 | metallothionein 1L | 11.4 |
| 433657 | AI244368 | Hs. 8124 | PH domain containing protein in retina 1 | 11.4 |
| 429612 | AF062649 | Hs. 252587 | pituitary tumor-transforming 1 | 11.4 |
| 423334 | AK000906 | Hs. 127273 | hypothetical protein FLJ10044 | 11.4 |
| 433053 | BE301909 | Hs. 279952 | glutathione S-transferase subunit 13 homolog | 11.4 |
| 428423 | AU076517 | Hs. 184276 | solute carrier family 9 (sodium/hydrogen exch | 11.3 |
| 442353 | BE379594 | Hs. 49136 | ESTs | 11.3 |
| 447700 | AI420183 | Hs. 171077 | ESTs, Weakly similar to similar to serine/thr | 11.3 |
| 402077 | | | 0 | 11.3 |
| 409203 | AA780473 | Hs. 687 | cytochrome P450, subfamily IVB, polypeptide 1 | 11.3 |
| 405145 | | | 0 | 11.3 |
| 428248 | AI126772 | Hs. 40479 | ESTs | 11.3 |
| 425508 | AA991551 | Hs. 97013 | ESTs | 11.3 |
| 428340 | AF261088 | Hs. 154721 | aconitase 1, soluble | 11.3 |
| 431452 | AI073641 | Hs. 152372 | ESTs | 11.3 |
| 446651 | AA393907 | Hs. 97179 | ESTs | 11.3 |
| 443755 | C18397 | Hs. 9730 | tachykinin 3 (neuromedin K, neurokinin beta) | 11.3 |
| 436209 | AW850417 | Hs. 254020 | ESTs, Moderately similar to unnamed protein p | 11.3 |
| 401020 | | | 0 | 11.3 |
| 456724 | AW247388 | Hs. 301423 | calcium binding protein 1 (calbrain) | 11.2 |
| 407227 | H94949 | Hs. 171955 | trophinin associated protein (tastin) | 11.2 |
| 402066 | | | 0 | 11.2 |
| 442721 | AI015892 | Hs. 101282 | *Homo sapiens* mRNA, cDNA: DKFZp434B102 (from cl | 11.2 |
| 401025 | | | 0 | 11.2 |
| 452423 | AA991724 | Hs. 180535 | *Homo sapiens* cDNA: FLJ22711 fis, clone HSI133 | 11.2 |
| 431685 | AW296135 | Hs. 267659 | van 3 oncogene | 11.2 |
| 425176 | AW015644 | Hs. 301430 | ESTs, Moderately similar to TEF1_HUMAN TRANSC | 11.2 |
| 435496 | AW840171 | Hs. 265398 | ESTs, Weakly similar to transformation-relate | 11.2 |
| 409079 | W87707 | Hs. 82065 | interleukin 6 signal transducer (gp130, oncos | 11.2 |
| 456995 | T89832 | Hs. 170278 | ESTs | 11.2 |
| 419223 | X60111 | Hs. 1244 | CD9 antigen (p24) | 11.2 |
| 407788 | BE514982 | Hs. 38991 | S100 calcium-binding protein A2 | 11.2 |
| 407604 | AW191962 | Hs. 288061 | actin, beta | 11.2 |
| 437929 | T09353 | Hs. 106642 | ESTs, Weakly similar to hypothetical protein | 11.1 |
| 415789 | H01581 | | gb: yj33f08 r1 Soares placenta Nb2HP Homo sapi | 11.1 |
| 424447 | AL137376 | Hs. 147368 | *Homo sapiens* mRNA, cDNA: DKFZp434J0226 (from c | 11.1 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 436034 | AF282693 | Hs. 150185 | inflammation-related G protein-coupled recept | 11.1 |
| 404931 | | | 0 | 11.1 |
| 445979 | AI695047 | Hs. 202395 | ESTs | 11.1 |
| 446733 | AA863360 | Hs. 26040 | ESTs, Highly similar to CYTOCHROME P45 IVA2 | 11.1 |
| 433133 | AB027249 | Hs. 104741 | PDZ-binding kinase; T-cell originated protein | 11.1 |
| 445258 | AI635931 | Hs. 147613 | ESTs | 11.1 |
| 417251 | AW015242 | Hs. 99488 | ESTs, Weakly similar to ORF YKR074w [S.cerevi | 11.1 |
| 421041 | N36914 | Hs. 14691 | ESTs | 11.1 |
| 425537 | AB007913 | Hs. 158291 | KIAA0444 protein | 11.1 |
| 435763 | AI243929 | Hs. 190419 | ESTs | 11.1 |
| 444790 | AB030506 | Hs. 11955 | B9 protein | 11.1 |
| 453857 | AL080235 | Hs. 35861 | DKFZP586E1621 protein | 11.1 |
| 433882 | U90441 | Hs. 3622 | procollagen-proline, 2-oxoglutarate 4-dioxyge | 11.1 |
| 405358 | | | 0 | 11.1 |
| 435814 | AW615179 | Hs. 152870 | ESTs | 11.0 |
| 422809 | AK001379 | Hs. 121028 | hypothetical protein FLJ10549 | 11.0 |
| 446772 | AW294404 | Hs. 144515 | *Homo sapiens* cDNA: FLJ11672 fis, clone HEMBA10 | 11.0 |
| 456694 | AW016382 | Hs. 105642 | *Homo sapiens* cDNA: FLJ23271 fis, clone HEP001 | 11.0 |
| 441128 | AA570256 | Hs. 54628 | ESTs | 11.0 |
| 432677 | NM_004482 | Hs. 278611 | UDP-N-acetyl-alpha-D-galactosamine polypeptid | 11.0 |
| 412576 | AA447718 | Hs. 107057 | ESTs | 11.0 |
| 411122 | F00809 | Hs. 143696 | coactivator-associated arginine methyltransfe | 11.0 |
| 427225 | AA432391 | Hs. 258903 | *Homo sapiens* mRNA for KIAA1640 protein, parti | 11.0 |
| 426260 | NM_002541 | Hs. 168669 | oxoglutarate dehydrogenase (lipoamide) | 11.0 |
| 444652 | BE513613 | Hs. 11538 | actin related protein 2/3 complex, subunit 1A | 11.0 |
| 431947 | AL359613 | Hs. 49933 | hypothetical protein DKFZp762D1011 | 11.0 |
| 414432 | BE378174 | Hs. 26506 | *Homo sapiens* clone CDABP0005 mRNA sequence | 11.0 |
| 458627 | AW088642 | Hs. 97984 | ESTs; Weakly similar to WASP-family protein [ | 10.9 |
| 409142 | AL136877 | Hs. 50758 | chromosome-associated polypeptide C | 10.9 |
| 447627 | AF090922 | Hs. 285902 | CGI-113 protein | 10.9 |
| 447656 | NM_003726 | Hs. 19126 | src kinase-associated phosphoprotein of 55 kD | 10.9 |
| 454227 | AW963897 | Hs. 44743 | KIAA1435 protein | 10.9 |
| 402927 | | | 0 | 10.9 |
| 422380 | AA309881 | Hs. 136246 | ESTs | 10.9 |
| 455986 | BE177736 | | gb: RC1-HT0598-140300-021-g06 HT0598 Homo sapi | 10.9 |
| 410962 | BE273749 | Hs. 752 | FK506-binding protein 1A (12 kD) | 10.9 |
| 450361 | BE327108 | Hs. 202512 | ESTs | 10.9 |
| 457484 | H57645 | | gb: yr21e01.r1 Soares fetal liver spleen 1NFLS | 10.9 |
| 407903 | AI287341 | Hs. 154029 | bHLH factor Hes4 | 10.9 |
| 403398 | | | 0 | 10.9 |
| 401405 | | | 0 | 10.9 |
| 405570 | | | 0 | 10.9 |
| 421240 | R72730 | Hs. 29283 | ESTs, Weakly similar to PLK_HUMAN PROTEOGLYCA | 10.9 |
| 403649 | | | 0 | 10.9 |
| 447824 | BE620800 | | gb: 601483379T1 NIH_MGC_69 *Homo sapiens* cDNA: c | 10.9 |
| 450935 | BE514743 | Hs. 25664 | tumor suppressor deleted in oral cancer-relat | 10.9 |
| 439853 | AL119566 | Hs. 6721 | lysophospholipase-like | 10.9 |
| 451852 | R51928 | | gb: yj71c05 r1 Soares breast 2NbHBst Homo sapi | 10.9 |
| 431218 | NM_002145 | Hs. 2733 | homeo box B2 | 10.9 |
| 457794 | AA689292 | Hs. 246850 | ESTs | 10.9 |
| 444374 | AA009841 | Hs. 11039 | *Homo sapiens* cDNA: FLJ12798 fis, clone NT2RP20 | 10.9 |
| 456566 | AW235317 | Hs. 259214 | ESTs | 10.8 |
| 405552 | | | 0 | 10.8 |
| 439436 | BE140845 | Hs. 57868 | ESTs | 10.8 |
| 435310 | AA705075 | Hs. 169536 | Rhesus blood group-associated glycoprotein | 10.8 |
| 411125 | AA151647 | Hs. 68877 | cytochrome b-245, alpha polypeptide | 10.8 |
| 415807 | H03139 | Hs. 24683 | ESTs | 10.8 |
| 409430 | R21945 | Hs. 166975 | splicing factor, arginine/serine-rich 5 | 10.8 |
| 417033 | H83784 | Hs. 40532 | ESTs, Weakly similar to PEBP MOUSE PHOSPHATID | 10.8 |
| 418464 | R87580 | | gb: ym89h07.r1 Soares adult brain N2b4HB55Y Ho | 10.8 |
| 404567 | | | 0 | 10.8 |
| 418384 | AW149266 | Hs. 25130 | ESTs | 10.8 |
| 421971 | U63127 | Hs. 110121 | SEC7 homolog | 10.8 |
| 428769 | AW207175 | Hs. 106771 | ESTs | 10.8 |
| 459104 | R19238 | Hs. 282057 | ESTs | 10.8 |
| 410896 | AW809637 | | gb: MR4-ST0124-261099-015-b07 ST0124 Homo sapi | 10.8 |
| 416969 | AI815443 | Hs. 283404 | organic cation transporter | 10.8 |
| 408796 | AA688292 | Hs. 118553 | ESTs | 10.8 |
| 426298 | AW965058 | Hs. 111583 | ESTs | 10.8 |
| 421595 | AB014520 | Hs. 105958 | *Homo sapiens* cDNA: FLJ22735 fis, clone HUV001 | 10.8 |
| 408007 | AW135965 | Hs. 246783 | ESTs | 10.8 |
| 400167 | | | 0 | 10.7 |
| 445243 | AI217439 | Hs. 109854 | ESTs, Weakly similar to ALU1_HUMAN ALU SUBFAM | 10.7 |
| 421733 | AL119671 | Hs. 1420 | fibroblast growth factor receptor 3 (achondro | 10.7 |
| 412241 | AW948343 | | gb: RC0-MT0015-130400-031-c01 MT0015 Homo sapi | 10.7 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 425827 | W28316 | | gb: 45b6 Human retina cDNA: randomly primed sub | 10.7 |
| 420255 | NM_007289 | Hs. 1298 | membrane metallo-endopeptidase (neutral endop | 10.7 |
| 430891 | U22492 | Hs. 248118 | G protein-coupled receptor 8 | 10.7 |
| 402883 | | | 0 | 10.7 |
| 423811 | AW299598 | Hs. 50895 | homeo box C4 | 10.7 |
| 447078 | AW885727 | Hs. 301570 | ESTs | 10.7 |
| 414343 | AL036166 | Hs. 75914 | coated vesicle membrane protein | 10.7 |
| 446913 | AA430650 | Hs. 16529 | transmembrane 4 superfamily member (tetraspan | 10.7 |
| 452279 | AA286844 | Hs. 61260 | hypothetical protein FLJ13164 | 10.7 |
| 401220 | | | 0 | 10.7 |
| 459259 | AJ003294 | | gb: AJ003294 Selected chromosome 21 cDNA libra | 10.7 |
| 414171 | AA360328 | Hs. 865 | RAP1A, member of RAS oncogene family | 10.7 |
| 448449 | BE314567 | Hs. 211440 | ESTs | 10.7 |
| 429670 | L01087 | Hs. 211593 | protein kinase C, theta | 10.7 |
| 446759 | R61463 | Hs. 16165 | expressed in activated T/LAK lymphocytes | 10.7 |
| 400776 | | | 0 | 10.7 |
| 428093 | AW594506 | Hs. 104830 | ESTs | 10.7 |
| 412801 | AA121055 | | gb: zm22b01 r1 Stratagene pancreas (937208) Ho | 10.6 |
| 440545 | AW183201 | Hs. 190559 | ESTs | 10.6 |
| 434540 | NM_016045 | Hs. 5184 | TH1 drosophila homolog | 10.6 |
| 414273 | BE269057 | | gb: 601184231F1 NIH_MGC_8 Homo sapiens cDNA cl | 10.6 |
| 401817 | | | 0 | 10.6 |
| 410423 | AW402432 | Hs. 63489 | protein tyrosine phosphatase, non-receptor ty | 10.6 |
| 430590 | AW383947 | Hs. 246381 | CD68 antigen | 10.6 |
| 426680 | AA320160 | Hs. 171811 | adenylate kinase 2 | 10.6 |
| 445413 | AA151342 | Hs. 12677 | CGI-147 protein | 10.6 |
| 402947 | | | 0 | 10.6 |
| 457426 | AW971119 | | gb: EST383206 MAGE resequences, MAGL Homo sapi | 10.6 |
| 424148 | BE242274 | Hs. 1741 | integrin, beta 7 | 10.6 |
| 404944 | | | 0 | 10.6 |
| 405421 | | | 0 | 10.6 |
| 416772 | AI733872 | Hs. 79769 | protocadherin 1 (cadherin-like 1) | 10.6 |
| 414191 | AW250089 | Hs. 75807 | PDZ and LIM domain 1 (elfin) | 10.6 |
| 457588 | AI571225 | Hs. 284171 | KIAA1535 protein | 10.6 |
| 406038 | Y14443 | Hs. 88219 | zinc finger protein 200 | 10.6 |
| 404790 | | | 0 | 10.6 |
| 418922 | AW956580 | Hs. 42699 | Thrombospondin-1 (Hs. 87409) | 10.6 |
| 425940 | AB023184 | Hs. 163990 | KIAA0967 protein | 10.6 |
| 448749 | AW859679 | Hs. 21902 | Homo sapiens clone 25237 mRNA sequence | 10.6 |
| 418870 | AF147204 | Hs. 89414 | CXCR4, chemokine CXC receptor 4 (fusin) | 10.5 |
| 417933 | X02308 | Hs. 82962 | thymidylate synthetase | 10.5 |
| 450538 | AW297396 | Hs. 227052 | ESTs | 10.5 |
| 427928 | AA417662 | Hs. 119217 | ESTs | 10.5 |
| 432721 | AL121478 | Hs. 3132 | steroidogenic acute regulatory protein | 10.5 |
| 429267 | AA299290 | Hs. 246857 | ESTs, Highly similar to S71100 protein kinase | 10.5 |
| 439190 | AW978693 | Hs. 293811 | ESTs | 10.5 |
| 408975 | AW958693 | Hs. 49391 | hypothetical protein LOC54149 | 10.5 |
| 415130 | W85893 | Hs. 249867 | ESTs | 10.5 |
| 425738 | H29630 | Hs. 159408 | Homo sapiens clone 24420 mRNA sequence | 10.5 |
| 440232 | AI766925 | Hs. 112554 | ESTs | 10.5 |
| 425065 | AA371906 | Hs. 294151 | ESTs, Moderately similar to KIAA0544 protein | 10.5 |
| 420829 | AW665612 | Hs. 221969 | ESTs | 10.5 |
| 430466 | AF052573 | Hs. 241517 | polymerase (DNA directed), theta | 10.5 |
| 407771 | AL138272 | Hs. 62713 | ESTs | 10.5 |
| 444611 | AK002180 | Hs. 11449 | DKFZP564O123 protein | 10.5 |
| 444665 | BE613126 | Hs. 47783 | ESTs, Weakly similar to T12540 hypothetical p | 10.5 |
| 448030 | N30714 | Hs. 20161 | HDCME31P protein | 10.5 |
| 438982 | AW979101 | Hs. 291980 | ESTs | 10.5 |
| 446224 | AW450551 | Hs. 13308 | ESTs | 10.5 |
| 405108 | | | 0 | 10.5 |
| 438233 | W52448 | Hs. 56147 | ESTs | 10.5 |
| 401799 | | | 0 | 10.5 |
| 454038 | X06374 | Hs. 37040 | platelet-derived growth factor alpha polypept | 10.5 |
| 414222 | AL135173 | Hs. 878 | sorbitol dehydrogenase | 10.5 |
| 421828 | AW891965 | Hs. 289109 | dimethylarginine dimethylaminohydrolase 1 | 10.5 |
| 422626 | AA344932 | Hs. 118786 | metallothionein 2A | 10.5 |
| 449261 | AI637592 | Hs. 224958 | ESTs | 10.4 |
| 416218 | R21499 | Hs. 23213 | ESTs | 10.4 |
| 457848 | W26524 | Hs. 125682 | ESTs, Weakly similar to D2092 2 [C. elegans] | 10.4 |
| 442577 | AA292998 | Hs. 163900 | ESTs | 10.4 |
| 406505 | AF016272 | Hs. 115418 | cadherin 16, KSP-cadherin | 10.4 |
| 412258 | AA376768 | Hs. 288977 | Homo sapiens cDNA FLJ22622 fis, clone HSI056 | 10.4 |
| 429224 | AI905780 | Hs. 198272 | NADH dehydrogenase (ubiquinone) 1 beta subcom | 10.4 |
| 447774 | BE018118 | Hs. 19554 | chromosome 1 open reading frame 2 | 10.4 |
| 403914 | | | 0 | 10.4 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 406329 | | | 0 | 10.4 |
| 402423 | | | 0 | 10.4 |
| 431986 | AA536130 | Hs. 149018 | ESTs | 10.4 |
| 423145 | BE264548 | Hs. 222190 | ESTs, Weakly similar to secretory carrier mem | 10.4 |
| 414402 | BE294186 | | gb: 601172959F1 NIH_MGC_17 Homo sapiens cDNA: c | 10.4 |
| 417079 | U65590 | Hs. 81134 | interleukin 1 receptor antagonist | 10.4 |
| 426095 | AI278023 | Hs. 89986 | ESTs | 10.4 |
| 434577 | R37316 | Hs. 179769 | Homo sapiens cDNA FLJ22487 fis, clone HRC109 | 10.4 |
| 442415 | AI005101 | Hs. 129550 | ESTs | 10.3 |
| 421506 | BE302796 | Hs. 105097 | thymidine kinase 1, soluble | 10.3 |
| 435084 | D17516 | Hs. 301607 | adenylate cyclase activating polypeptide 1 (p | 10.3 |
| 431724 | AA514535 | Hs. 283704 | ESTs | 10.3 |
| 456798 | AJ006422 | Hs. 135183 | centaurin-alpha | 10.3 |
| 417370 | T28651 | Hs. 82030 | tryptophanyl-tRNA synthetase | 10.3 |
| 422596 | AF063611 | Hs. 118633 | 2'-5'oligoadenylate synthetase-like | 10.3 |
| 435226 | AI248938 | Hs. 270106 | ESTs | 10.3 |
| 433192 | AB040880 | Hs. 225594 | ESTs, Moderately similar to KIAA1447 protein | 10.3 |
| 419879 | Z17805 | Hs. 93564 | Homer, neuronal immediate early gene, 2 | 10.3 |
| 416228 | AW505190 | Hs. 79089 | sema domain, immunoglobulin domain (Ig), tran | 10.3 |
| 453403 | BE466639 | Hs. 61779 | Homo sapiens cDNA FLJ13591 fis, clone PLACE10 | 10.3 |
| 447906 | AL050062 | Hs. 19999 | DKFZP566K023 protein | 10.3 |
| 401782 | NM_012434 | Hs. 117865 | solute carrier family 17 (anion/sugar transpo | 10.3 |
| 453927 | AA082465 | Hs. 301751 | ESTs, Weakly similar to/prediction | 10.3 |
| 450737 | AW007152 | Hs. 203330 | ESTs | 10.3 |
| 421633 | AF121860 | Hs. 106260 | sorting nexin 10 | 10.3 |
| 409881 | AF139799 | Hs. 202830 | ESTs | 10.3 |
| 432883 | U48936 | Hs. 3112 | sodium channel, nonvoltage-gated 1, gamma | 10.3 |
| 440099 | AL080058 | Hs. 6909 | DKFZP564G202 protein | 10.3 |
| 419024 | X56411 | Hs. 1219 | alcohol dehydrogenase 4 (class II), pi polype | 10.3 |
| 401835 | | | 0 | 10.3 |
| 408896 | AI610447 | Hs. 48778 | niban protein | 10.3 |
| 443120 | AW402677 | Hs. 290801 | ESTs | 10.3 |
| 400208 | | | 0 | 10.2 |
| 416908 | AA333990 | Hs. 80424 | coagulation factor XIII, A1 polypeptide | 10.2 |
| 400166 | | | 0 | 10.2 |
| 434642 | W25739 | Hs. 135287 | ESTs | 10.2 |
| 424837 | BE276113 | Hs. 153436 | N-acetyltransferase, homolog of S cerevisiae | 10.2 |
| 435075 | R51094 | Hs. 12400 | ESTs | 10.2 |
| 425912 | AL137629 | Hs. 162189 | serine/threonine kinase with Dbl- and pleckst | 10.2 |
| 435080 | AI831760 | Hs. 155111 | ESTs | 10.2 |
| 414998 | NM_002543 | Hs. 77729 | oxidised low density lipoprotein (lectin-like | 10.2 |
| 410020 | T86315 | Hs. 728 | ribonuclease, RNase A family, 2 (liver, eosin | 10.2 |
| 411410 | R20693 | Hs. 69954 | laminin, gamma 3 | 10.2 |
| 450294 | H42587 | Hs. 238730 | ESTs | 10.2 |
| 421154 | AA284333 | Hs. 287631 | Homo sapiens cDNA: FLJ14269 fis, clone PLACE10 | 10.2 |
| 414271 | AK000275 | Hs. 75871 | protein kinase C binding protein 1 | 10.2 |
| 400812 | | | 0 | 10.2 |
| 425843 | BE313280 | Hs. 159627 | death associated protein 3 | 10.2 |
| 449392 | Z41698 | Hs. 26039 | Homo sapiens cDNA: FLJ13937 fis, clone Y79AA10 | 10.2 |
| 409089 | NM_014781 | Hs. 50421 | KIAA0203 gene product | 10.2 |
| 401383 | | | 0 | 10.2 |
| 456855 | AF035528 | Hs. 153863 | MAD (mothers against decapentaplegic, Drosoph | 10.2 |
| 442912 | AI088060 | Hs. 131450 | ESTs | 10.2 |
| 400954 | D25969 | Hs. 76325 | Homo sapiens cDNA: FLJ23125 fis, clone LNG082 | 10.2 |
| 401029 | BE382701 | Hs. 25960 | v-myc avian myelocytomatosis viral related on | 10.2 |
| 416602 | NM_006159 | Hs. 79389 | nel (chicken)-like 2 | 10.2 |
| 421905 | AI660247 | Hs. 32699 | ESTs, Weakly similar to LIV-1 protein [H.sapi | 10.2 |
| 405094 | | | 0 | 10.2 |
| 450832 | AW970602 | Hs. 105421 | ESTs | 10.2 |
| 440076 | R32052 | Hs. 178617 | ESTs, Weakly similar to AF151840 1 CGI-82 pro | 10.2 |
| 447563 | BE536115 | Hs. 160983 | ESTs | 10.2 |
| 421238 | AB033101 | Hs. 102796 | KIAA1275 protein | 10.2 |
| 400882 | | | 0 | 10.2 |
| 415738 | BE539367 | Hs. 295953 | ESTs, Weakly similar to AF220049 1 uncharacte | 10.1 |
| 445464 | AW172389 | Hs. 249999 | ESTs | 10.1 |
| 459042 | AW272058 | Hs. 210338 | ESTs | 10.1 |
| 414469 | R51952 | Hs. 32587 | steriod receptor RNA activator 1 (complexes w | 10.1 |
| 434732 | AI078443 | | gb: oz05g05 x1 Soares_fetal_liver_spleen_1NFLS | 10.1 |
| 441030 | AW204139 | Hs. 174424 | ESTs, Weakly similar to p140mDia [M.musculus] | 10.1 |
| 446855 | BE616767 | Hs. 16269 | B-cell CLL/lymphoma 7B | 10.1 |
| 456785 | AF151074 | Hs. 132744 | hypothetical protein | 10.1 |
| 404182 | | | 0 | 10.1 |
| 410358 | AW975168 | Hs. 13337 | ESTs, Weakly similar to unnamed protein produ | 10.1 |
| 430355 | NM_006219 | Hs. 239818 | phosphoinositide-3-kinase, catalytic, beta po | 10.1 |
| 442152 | R39246 | Hs. 239666 | Homo sapiens cDNA: FLJ13495 fis, clone PLACE10 | 10.1 |

TABLE 13A-continued

About 1086 UP-REGULATED GENES, OVARIAN CANCER VERSUS NORMAL OVARY

| Pkey | Ex. Accn | UG ID | Title | ratio |
|---|---|---|---|---|
| 436354 | AI879252 | Hs. 5151 | Homo sapiens mRNA, cDNA: DKFZp564C2163 (from c | 10.1 |
| 426711 | AA383471 | Hs. 180669 | conserved gene amplified in osteosarcoma | 10.1 |
| 450599 | AA460865 | Hs. 48516 | ESTs | 10.1 |
| 454393 | BE153288 | | gb: PM0-HT0335-180400-008-c08 HT0335 Homo sapi | 10.1 |
| 403383 | | | 0 | 10.1 |
| 415947 | U04045 | Hs. 78934 | mutS (E. coli) homolog 2 (colon cancer, nonpo | 10.1 |
| 411773 | NM_006799 | Hs. 72026 | protease, serine, 21 (testisin) | 10.1 |
| 412116 | AW402166 | Hs. 784 | Epstein-Barr virus induced gene 2 (lymphocyte | 10.1 |
| 413808 | J00287 | Hs. 182183 | caldesmon 1 | 10.0 |
| 458572 | AI223423 | Hs. 292794 | ESTs | 10.0 |
| 403295 | | | 0 | 10.0 |
| 403910 | | | 0 | 10.0 |
| 453400 | AI991901 | Hs. 82590 | ESTs, Moderately similar to ALU7_HUMAN ALU SU | 10.0 |
| 406502 | | | 0 | 10.0 |
| 404743 | | | 0 | 10.0 |
| 412517 | BE271584 | | gb: 601141065F1 NIH_MGC_9 Homo sapiens cDNA cl | 10.0 |
| 402679 | | | 0 | 10.0 |
| 455864 | BE148970 | | gb: CM0-HT0245-031199-085-h05 HT0245 Homo sapi | 10.0 |
| 425734 | AF056209 | Hs. 159396 | peptidylglycine alpha-amidating monooxygenase | 10.0 |
| 419280 | W07506 | Hs. 283725 | Homo sapiens cDNA FLJ12627 fis, clone NT2RM40 | 10.0 |
| 443503 | AV645438 | Hs. 282927 | ESTs | 10.0 |
| 423165 | AI937547 | Hs. 124915 | Human DNA sequence from clone 380A1 on chromo | 10.0 |
| 450206 | AI796450 | Hs. 201600 | ESTs | 10.0 |
| 459052 | AA298812 | Hs. 98539 | ESTs | 10.0 |
| 456248 | AL035786 | Hs. 82425 | actin related protein 2/3 complex, subunit 5 | 10.0 |
| 428438 | NM_001955 | Hs. 2271 | Endothelin 1 | 10.0 |
| 456525 | AW468397 | Hs. 100000 | S100 calcium-binding protein A8 (calgranulin | 10.0 |
| 426127 | L36983 | Hs. 167013 | dynamin 2 | 10.0 |

Pkey: Primekey
Ex. Accn Exemplay Accession
UG ID. UniGene ID
Title: UniGene title
ratio: ration tumor vs normal ovary

TABLE 13B

| Pkey | CAT Number | Accession |
|---|---|---|
| 410896 | 1226053_1 | AW809637 AW809697 AW810554 AW809707 AW809885 AW810000 AW810088 AW809742 AW809816 AW809749 AW809639 AW809722 AW809836 AW809774 AW810023 AW810013 AW809813 AW809660 AW809728 AW809768 AW809951 AW809657 AW809954 |
| 412153 | 1279701_1 | R87934 AW898205 AW896020 AW896035 |
| 412241 | 1284681_1 | AW948343 AW948341 AW902855 AW984737 |
| 412517 | 130281_1 | BE271584 AA112511 |
| 412801 | 132825_1 | AA121055 AA330917 |
| 413349 | 1363558_1 | BE086692 BE087077 BE087072 |
| 414273 | 1431911_1 | BE269057 BE513434 BE396654 |
| 414402 | 1443240_1 | BE294186 BE298975 |
| 414950 | 1509777_1 | C15407 D81769 D61133 |
| 415789 | 1555357_1 | H01581 H12850 R65905 H13053 |
| 416368 | 1591066_1 | R88849 R84573 H50890 |
| 418464 | 1759038_-2 | R87580 |
| 418783 | 1789791_1 | T41368 T41369 T41294 |
| 424627 | 241724_1 | AA344555 AA344312 AW963070 |
| 425827 | 256834_1 | W28316 W26507 AA364334 |
| 434371 | 384839_1 | AA631362 AA631438 |
| 434414 | 38585_1 | AI798376 S46400 AW811617 AW811616 W00557 BE142245 AW858232 AW861851 AW858362 AA232351 AA218567 AA055556 AW858231 AW857541 AW814172 H66214 AW814398 AF134164 AA243093 AA173345 AA199942 AA223384 AA227092 AA227080 T12379 AA092174 T61139 AA149776 AA699829 AW879188 AW813567 AW813538 AI267168 AA157718 AA157719 AA100472 AA100774 AA130756 AA157705 AA157730 AA157715 AA053524 AW849581 AW854566 C05254 AW882836 T92637 AW812621 AA206583 AA209204 BE156909 AA226824 AI829309 AW991957 N66951 AA527374 H66215 AA045564 AI694265 H60808 AA149726 AW195620 BE081333 BE073424 AW817662 AW817705 AW817703 AW817659 BE081531 H59570 |
| 434732 | 392447_1 | AI078443 AA648102 AI765577 AW974381 |
| 439092 | 468554_1 | AA830149 AW978407 M85983 AW503637 |
| 439636 | 47467_1 | AF086467 W81444 W81445 |
| 447824 | 73861_-1 | BE620800 |
| 450484 | 83645_1 | BE220675 AA345621 AA009992 |
| 451260 | 863912_1 | AW750773 AI768154 |

TABLE 13B-continued

| Pkey | CAT Number | Accession |
|---|---|---|
| 451852 | 888359_1 | R51928 AI820698 R48360 AI820694 |
| 452101 | 898742_1 | T60298 AI858257 T69667 T67634 T61224 T71537 T68933 |
| 454163 | 1048369_1 | AW175997 AW176000 AW175999 AW175994 AW176004 AW175989 |
| 454393 | 115888_1 | BE153288 BE153151 BE152925 AA078302 |
| 455102 | 1253524_1 | BE005496 BE005494 AW856324 AW900199 |
| 455864 | 1377038_1 | BE148970 BE148975 BE148957 BE148937 |
| 455986 | 1397521_1 | BE177736 BE177735 BE177734 |
| 456423 | 187241_1 | AW748920 AA487506 AA248914 AA780494 |
| 457426 | 336189_1 | AW971119 AA574265 AA513268 |
| 457484 | 342113_1 | H57645 T19302 AA527038 Z24851 H93171 |
| 457705 | 389383_1 | AW974668 AA661959 AA649572 AA640401 AA640402 |
| 459259 | 966269_1 | AJ003294 AJ003315 AJ003293 |

Pkey: Unique Eos probeset identifier number
CAT number: Gene cluster number
Accession Genbank accession numbers

TABLE 13C

| Pkey | Ref | Strand | Nt_position |
|---|---|---|---|
| 400640 | 8117686 | Plus | 144324–144429 |
| 400666 | 8118496 | Plus | 17982–18115, 20297–20456 |
| 400776 | 8131651 | Plus | 103576–103720 |
| 400812 | 8568711 | Plus | 71708–72153 |
| 400881 | 2842777 | Minus | 91446–91603, 92123–92265 |
| 400882 | 2842777 | Minus | 110431–110708 |
| 400965 | 7770576 | Minus | 173043–173564 |
| 401010 | 8117391 | Minus | 83967–84180 |
| 401020 | 8117458 | Minus | 59085–60227 |
| 401025 | 8117518 | Minus | 179287–179483, 181044–181166, 181844–182039 |
| 401047 | 6705887 | Minus | 4804–5035, 5133–5314 |
| 401131 | 8699812 | Minus | 94802–94987, 95804–95887, 96323–96487, 97596–97826 |
| 401192 | 9719502 | Minus | 69559–70101 |
| 401220 | 9929324 | Minus | 48079–48279 |
| 401383 | 6721135 | Minus | 155543–157381 |
| 401405 | 7768126 | Minus | 69276–69452, 69548–69958 |
| 401519 | 6649315 | Plus | 157315–157950 |
| 401532 | 7798785 | Plus | 124414–124950, 125050–125418 |
| 401610 | 7705041 | Minus | 18921–19505 |
| 401714 | 6715702 | Plus | 96484–96681 |
| 401735 | 3252819 | Plus | 217235–217356, 217621–217873 |
| 401799 | 7331447 | Plus | 147802–148251 |
| 401817 | 7417850 | Minus | 45888–46535 |
| 401835 | 7139700 | Plus | 142257–142742 |
| 401879 | 8099914 | Minus | 101064–102827 |
| 401888 | 8516069 | Minus | 189498–190514 |
| 401897 | 8569218 | Plus | 604–767 |
| 402066 | 6649269 | Plus | 135543–136031 |
| 402077 | 8117414 | Plus | 65014–65195 |
| 402104 | 8119072 | Plus | 122409–122600 |
| 402238 | 7690126 | Plus | 24726–24880, 26791–27021 |
| 402287 | 4559317 | Plus | 40811–42447 |
| 402389 | 9885999 | Minus | 771–972, 1571–1683 |
| 402408 | 9796239 | Minus | 110326–110491 |
| 402423 | 9796344 | Minus | 62487–62664 |
| 402424 | 9796344 | Minus | 64925–65073 |
| 402496 | 9797769 | Minus | 8615–9103 |
| 402520 | 7596899 | Minus | 171761–171996 |
| 402679 | 8113438 | Plus | 132079–132216 |
| 402840 | 9369121 | Minus | 57118–57306 |
| 402883 | 9926562 | Plus | 38666–38803, 38885–39019, 39097–39231, 39308–39445 |
| 402885 | 9926751 | Plus | 71919–72049 |
| 402926 | 8217647 | Minus | 41261–41443 |
| 402927 | 8217647 | Minus | 47247–47396 |
| 402943 | 6456831 | Plus | 38467–39068 |
| 402944 | 9368423 | Plus | 110411–110716, 111173–111640 |
| 402947 | 9368458 | Minus | 101629–101991 |
| 402965 | 9581599 | Minus | 46865–46941, 47032–47148 |
| 403022 | 3132351 | Plus | 92097–92864 |
| 403121 | 9180223 | Plus | 4059–4258 |
| 403165 | 9838098 | Minus | 90595–91848 |
| 403295 | 8096528 | Plus | 22386–22708 |
| 403381 | 9438267 | Minus | 26009–26178 |
| 403383 | 9438267 | Minus | 119837–121197 |

TABLE 13C-continued

| Pkey | Ref | Strand | Nt_position |
|---|---|---|---|
| 403398 | 6862689 | Minus | 13685–14699 |
| 403399 | 6684178 | Plus | 61841–62145, 62367–62756 |
| 403482 | 9966050 | Plus | 196964–197135 |
| 403485 | 9966528 | Plus | 2888–3001, 3198–3532, 3655–4117 |
| 403649 | 8705159 | Minus | 27141–27247 |
| 403910 | 7710710 | Minus | 5761–6188 |
| 403912 | 7710730 | Minus | 72000–72290, 72431–72700, 72929–73199 |
| 403914 | 7417588 | Minus | 7431–8472 |
| 404182 | 4775644 | Plus | 18163–18444 |
| 404502 | 7229863 | Minus | 56277–56819 |
| 404567 | 7249169 | Minus | 101320–101501 |
| 404678 | 9797204 | Plus | 115196–115448 |
| 404743 | 8894169 | Minus | 120556–120999 |
| 404780 | 9887810 | Minus | 175708–175871 |
| 404790 | 7230958 | Plus | 38611–38761 |
| 404931 | 7342203 | Plus | 44226–44382 |
| 404944 | 6899705 | Plus | 4256–4581 |
| 405024 | 7107727 | Plus | 88500–88697 |
| 405089 | 8072523 | Plus | 103182–103973 |
| 405094 | 8072579 | Plus | 135587–135758 |
| 405108 | 7107890 | Minus | 135020–135472 |
| 405145 | 9438278 | Plus | 37883–38052, 38138–38332 |
| 405192 | 7230070 | Plus | 115629–116071 |
| 405224 | 6731245 | Minus | 14413–15979 |
| 405295 | 3818412 | Plus | 56933–57099 |
| 405353 | 2811095 | Plus | 118525–118892 |
| 405358 | 2341017 | Minus | 18016–18315 |
| 405421 | 7243869 | Minus | 97411–97687 |
| 405426 | 7243900 | Minus | 37640–37817 |
| 405452 | 7656638 | Minus | 93876–94275 |
| 405484 | 5922025 | Plus | 199214–199579, 199672–199920, 200262–200495 |
| 405552 | 1552506 | Plus | 45199–45647 |
| 405570 | 2808656 | Plus | 98208–98331 |
| 405626 | 4508116 | Minus | 89275–89384, 92450–92629, 97091–97279, 98546–98666 |
| 405699 | 4165331 | Plus | 100727–100859 |
| 405762 | 5931935 | Plus | 160502–161110 |
| 405802 | 5924004 | Minus | 27743–28264 |
| 405804 | 7274891 | Minus | 122557–123551 |
| 406329 | 6982072 | Minus | 607903–608271 |
| 406429 | 9256476 | Minus | 83206–83365, 94051–94193 |
| 406502 | 7711350 | Minus | 63430–63602 |

Pkey: Unique number corresponding to an Eos probeset
Ref: Sequence source. The 7 digit numbers in this column are Genbank Identifier (GI) numbers. "Dunham I et al." refers to the publication entitled "The DNA sequence of human chromosome 22" Dunham, et al. (1999) Nature 402: 489–495
Strand Indicates DNA strand from which exons were predicted.
Nt_position Indicates nucleotide positions of predicted exons.

Table 14A lists about 1025 genes up-regulated in ovarian cancer compared to normal adult tissues. Genes associated with ovarian cancer were selected from 53462 probesets such that the ratio of "average" ovarian cancer to "average" normal adult tissue was greater than or equal to 5 0 The "average" ovarian cancer level was set to the 93rd percentile value amongst various ovarian cancer specimens, the "average" normal adult tissue level was set to the 96th percentile value amongst various non-malignant tissues In order to remove gene-specific background levels of non-specific hybridization, the 15th percentile value amongst the non-malignant tissue was subtracted from both the numerator and the denominator before the ratio was evaluated Tables 14B–18B show the accession numbers for those Pkey's lacking UnigeneID's for tables 14A–18A For each probeset is listed the gene cluster number from which oligonecleotides were designed. Gene clusters were compiled using sequences derived from Genbank ESTs and mRNAs These sequences were clustered based on sequence similarity using Clustering and Alignment Tools (DoubleTwist, Oakland Calif.) Genbank accession numbers for sequences comprising each cluster are listed in the "Accession" column.

Tables 14C–18C show genomic positioning for those Pkey's lacking Unigene ID's and accession numbers in tables 14A–18A. For each predicted exon is listed genomic sequence source used for prediction Nucleotide locations of each predicted exon are also listed

TABLE 14A

| Pkey | ExAccn | UniGene ID | Unigene Title | Pred Protein Dom | R1 |
|---|---|---|---|---|---|
| 421296 | NM_002666 | Hs. 103263 | perilipin | perilipin, SS | 32.5 |
| 453028 | AB006532 | Hs. 31442 | RecQ protein-like 4 | DEAD, helicase_C, Fork_head | 27.6 |

TABLE 14A-continued

| Pkey | ExAccn | UniGene ID | Unigene Title | Pred Protein Dom | R1 |
| --- | --- | --- | --- | --- | --- |
| 422310 | AA316622 | Hs. 98370 | cytochrome P450, subfamily IIS | SS, TM, pkinase, fn3, ig | 26.5 |
| 437897 | AA770561 | Hs. 146170 | hypothetical protein FLJ22969 | SS, TM, zf-DHHC | 26.3 |
| 446374 | AA329256 | Hs. 24756 | ESTs, Moderately similar to al | | 22.6 |
| 441021 | AW578716 | Hs. 7644 | H1 histone family, member 2 | | 22.3 |
| 409518 | BE384836 | Hs. 3454 | KIAA1821 protein | SS | 21.3 |
| 413436 | AF238083 | Hs. 68061 | sphingosine kinase 1 | DAGKc | 21.2 |
| 424420 | BE614743 | Hs. 146688 | prostaglandin E synthase | MAPEG, SS, TM, MAPEG | 20.7 |
| 422645 | L40027 | Hs. 118890 | glycogen synthase kinase 3 alp | pkinase, SS, Ets | 20.7 |
| 422098 | H03117 | Hs. 111497 | similar to mouse neuronal prot | TM | 20.2 |
| 429556 | AW139399 | Hs. 98988 | ESTs | SS, pkinase, PMP22_Claudin | 20.1 |
| 436485 | X59135 | Hs. 156110 | immunoglobulin kappa constant | SS, ig, SS | 19.9 |
| 423652 | AF052122 | Hs. 130712 | Homo sapiens clone 23929 mRNA | ABC1, SS, PID, PID | 19.8 |
| 431773 | BE409442 | Hs. 268557 | pleckstrin homology-like domai | PH, SS, LIM, Troponin | 19.4 |
| 422179 | AF091619 | Hs. 112667 | dynein, axonemal, intermediate | WD40, SS | 19.3 |
| 420839 | AI792682 | Hs. 282960 | hypothetical protein MGC10870 | SS, DS, UPF0139, Glyco_hydro | 18.5 |
| 441356 | BE384361 | Hs. 182885 | ESTs, Weakly similar to JC5024 | SS, TM, ank | 18.5 |
| 424659 | AW891298 | Hs. 331601 | Homo sapiens, Similar to cyste | SS, Fork_head | 18.4 |
| 439924 | AI985897 | Hs. 125293 | ESTs | SS | 18.1 |
| 458814 | AI498957 | Hs. 170861 | ESTs, Weakly similar to Z195_H | SS, TM, ldl_recept_a, ldl_re | 17.5 |
| 451643 | M64437 | Hs. 234799 | breakpoint cluster region | RhoGEF, RhoGAP, PH, C2 | 17.2 |
| 439108 | AW163034 | Hs. 6467 | synaptogyrin 3 | Synaptogyrn, SS, TM, PDZ, WD | 16.9 |
| 432945 | AL043683 | | hypothetical protein FLJ10803 | SS | 16.8 |
| 410418 | D31382 | Hs. 63325 | transmembrane protease, serine | SS, TM, ldl_recept_a, trypsi | 16.8 |
| 438424 | AI912498 | Hs. 25895 | hypothetical protein FLJ14996 | SS, TM | 16.7 |
| 409435 | AI810721 | Hs. 95424 | ESTs | SS | 16.4 |
| 418969 | W33191 | Hs. 28907 | hypothetical protein FLJ20258 | SH3, SH3 | 16.2 |
| 421612 | AF161254 | Hs. 106196 | 8D6 antigen | ldl_recept_a, SS, TM | 16.0 |
| 456177 | NM_012391 | Hs. 79414 | prostate epithelium-specific E | Ets, SAM_PNT | 15.7 |
| 414837 | U24266 | Hs. 77448 | aldehyde dehydrogenase 4 famil | aldedh | 15.6 |
| 432631 | H08379 | Hs. 165563 | hypothetical protein DKFZp434N | TM, DnaJ, UBA, ArfGap, homeob | 15.5 |
| 454017 | AW023617 | Hs. 347130 | hypothetical protein FLJ22709 | SS, TM, myosin_head, RA, DAG_ | 15.5 |
| 401278 | | | Target Exon | Band_41 | 15.4 |
| 444804 | AI084452 | Hs. 22158 | hypothetical protein FLJ21988 | SS | 15.4 |
| 410259 | AK000337 | Hs. 61485 | hypothetical protein | GFO_IDH_MocA, GFO_IDH_MocA | 15.4 |
| 406620 | M81105 | Hs. 146550 | myosin, heavy polypeptide 9, n | myosin_head, Myosin_fail, l | 15.1 |
| 423081 | AF262992 | Hs. 123159 | sperm associated antigen 4 | TM | 14.9 |
| 421495 | AI583067 | Hs. 149152 | ESTs, Weakly similar to RHOP M | | 14.7 |
| 416893 | AA455588 | Hs. 62406 | hypothetical protein FLJ22573 | SS, rrm, SS | 14.7 |
| 413244 | AW955951 | Hs. 159265 | kruppel-related zinc finger pr | SS, TM, BTB, pep_M12B_propep | 14.6 |
| 406901 | M14624 | | gb: Human 4-beta-galactosyltran | | 14.6 |
| 416006 | AA324251 | Hs. 78950 | branched chain keto acid dehyd | E1_dehydrog | 14.6 |
| 436186 | BE390717 | Hs. 5074 | similar to S pombe dim1 | DIM1, SS | 14.5 |
| 455557 | AW995859 | | gb: QV4-BN0044-110200-108-h07 B | Metallophos | 14.4 |
| 434518 | H56995 | Hs. 37372 | homo sapiens DNA binding pepti | SS | 14.2 |
| 421489 | AI922821 | Hs. 32433 | ESTs | SS, PI-PLC-X, PI-PLC-Y, C2 | 14.1 |
| 444441 | AW613841 | Hs. 301394 | hypothetical protein MGC3101 | | 14.0 |
| 435017 | AA336522 | Hs. 12854 | angiotensin II, type I recepto | | 14.0 |
| 446572 | AV659151 | Hs. 282961 | ESTs | | 13.9 |
| 434068 | AA977935 | Hs. 127274 | ESTs | SS | 13.7 |
| 432481 | AW451645 | Hs. 151504 | homo sapiens cDNA FLJ11973 fis | SS, Collagen, COLF1, TSPN | 13.7 |
| 447304 | Z98883 | Hs. 18079 | phosphatidylinositol glycan, c | SS, Peptidase_C2 | 13.6 |
| 421182 | AA284855 | Hs. 104480 | ESTs | SS, Topoisomerase_I, TopoIS | 13.3 |
| 407767 | W15398 | Hs. 38628 | hypothetical protein | SS, zf-CCCH | 13.3 |
| 456642 | AW451623 | Hs. 109752 | putative c-Myc-responsive | | 13.3 |
| 437457 | AA757900 | Hs. 270823 | ESTs, Weakly similar to S65657 | SQS_PSY | 13.2 |
| 430178 | AW449612 | Hs. 152475 | ESTs | SS | 13.1 |
| 430399 | AI916284 | Hs. 199671 | ESTs | Sec7, PH | 12.9 |
| 436725 | BE045223 | Hs. 136912 | hypothetical protein MGC10796 | | 12.9 |
| 410219 | T98226 | Hs. 171952 | occludin | SS, TM, Occludin, BIR | 12.7 |
| 442620 | C00138 | Hs. 8535 | Homo sapiens mRNA for KIAA1668 | SS, RNA_pol_K | 12.7 |
| 439233 | AA831893 | Hs. 292767 | hypothetical protein FLJ23109 | zf-C3HC4, TM, Sulfate_trans | 12.7 |
| 425018 | BE245277 | Hs. 154196 | E4F transcription factor 1 | zf-C2H2, LIM, SS, Exo_endo_p | 12.6 |
| 423801 | NM_015071 | Hs. 132942 | GTPase regulator associated wi | RhoGAP, SH3, PH | 12.6 |
| 417826 | T85105 | Hs. 15471 | ESTs | SS, cadherin, Cadherin_C_te | 12.6 |
| 409261 | BE315042 | Hs. 19210 | hypothetical protein MGC11308 | | 12.6 |
| 420568 | F09247 | Hs. 247735 | protocadherin alpha 10 | cadherin, SS, TM, cadherin | 12.6 |
| 411570 | BE144584 | Hs. 314341 | ESTs | | 12.5 |
| 430397 | AI924533 | Hs. 105607 | bicarbonate transporter relate | HCO3_cotransp, SS, TM | 12.5 |
| 423767 | H18283 | Hs. 132753 | F-box only protein 2 | F-box, SS, F-box, HORMA | 12.4 |
| 441805 | AA285136 | Hs. 301914 | neuronal specific transcriptio | LIM, SS, LIM | 12.3 |
| 402365 | | | Target Exon | SS, SS, TM, ig | 12.2 |
| 414371 | AI905865 | | thymosin, beta 4, X chromosome | Thymosin | 12.2 |
| 446780 | R31107 | | gb: yh61g01 s1 Soares placenta | | 12.1 |
| 428782 | X12830 | Hs. 193400 | interleukin 6 receptor | SS, TM, fn3, ig, SS, TM | 12.1 |
| 427695 | R88483 | Hs. 172862 | intron of Bicaudal D homolog 1 | | 12.1 |
| 400460 | | | C11002253* gi|129091|sp|P23267 | SS, TM, SCAN, zf-C2H2, KRAB | 12.0 |
| 407341 | AA918886 | Hs. 204918 | ESTs, Weakly similar to ALU8_H | SS, TM | 12.0 |

TABLE 14A-continued

| Pkey | ExAccn | UniGene ID | Unigene Title | Pred Protein Dom | R1 |
|---|---|---|---|---|---|
| 424049 | AB014524 | Hs. 138380 | KIAA0624 protein | SS | 11.9 |
| 422872 | BE326786 | Hs. 187646 | ESTs | TM | 11.9 |
| 450800 | BE395161 | Hs. 1390 | proteasome (prosome, macropain | SS | 11.8 |
| 428648 | AF052728 | Hs. 188021 | potassium voltage-gated channe | cNMP_binding | 11.7 |
| 432329 | NM_002962 | Hs. 2960 | S100 calcium-binding protein A | S_100, efhand, SS, efhand, S_ | 11.7 |
| 417061 | AI675944 | Hs. 188691 | Homo sapiens cDNA FLJ12033 fis | CTF_NFI | 11.6 |
| 451195 | U10492 | Hs. 438 | mesenchyme homeo box 1 | homeobox, SS | 11.5 |
| 417595 | AA424317 | Hs. 6259 | KIAA1698 protein | SS, TM, Glyco_hydro_31, Glyc | 11.5 |
| 426500 | NM_014638 | Hs. 170156 | KIAA0450 gene product | SS | 11.4 |
| 433124 | U51712 | Hs. 13775 | hypothetical protein SMAP31 | | 11.4 |
| 444001 | AI095087 | Hs. 152299 | ESTs, Moderately similar to S6 | | 11.4 |
| 419298 | AA853479 | Hs. 89890 | pyruvate carboxylase | CPSase_L_chain, PYC_OADA, H | 11.4 |
| 428593 | AW207440 | Hs. 185973 | degenerative spermatocyte (hom | SS | 11.3 |
| 411408 | U76666 | Hs. 69949 | calcium channel, voltage-depen | ion_trans, SS, TM | 11.2 |
| 404438 | | | Target Exon | | 11.2 |
| 427448 | BE246449 | Hs. 2157 | Wiskott-Aldrich syndrome (ecze | WH1, PBD, WH2, SS | 11.2 |
| 406230 | | | Target Exon | | 11.2 |
| 432125 | AW972667 | Hs. 183006 | Homo sapiens cDNA FLJ12300 fis | Band_41, ERM | 11.2 |
| 408832 | AW085690 | Hs. 63428 | ESTs, Weakly similar to Z195_H | | 11.1 |
| 400206 | | | Eos Control | SS, SS, Glyco_tranf_43, COLF | 11.1 |
| 450503 | R35917 | Hs. 301338 | hypothetical protein FLJ12587 | SS | 11.0 |
| 407605 | W03512 | Hs. 6479 | hypothetical protein MGC13272 | SS, Sema, pkinase, TIG, PSI, e | 11.0 |
| 432143 | AL040183 | Hs. 123484 | Homo sapiens, clone IMAGE 4178 | SS, TM, cys_rich_FGFR | 10.9 |
| 446839 | BE091926 | Hs. 16244 | mitotic spindle coiled-coil re | Troponin, SS, glycolytic_en | 10.8 |
| 443559 | AI076765 | Hs. 269899 | ESTs, Moderately similar to AL | SS, TM, BIR, UQ_com | 10.8 |
| 411298 | AW835858 | | gb: PM0-LT0017-031299-001-h07 L | | 10.8 |
| 409557 | BE182896 | Hs. 211193 | ESTs | | 10.8 |
| 435158 | AW663317 | Hs. 65588 | DAZ associated protein 1 | rrm, SS, rrm | 10.8 |
| 444410 | BE387360 | Hs. 33719 | ESTs, Moderately similar to S6 | SS | 10.6 |
| 428948 | BE514362 | | FK506-binding protein 3 (25 kD) | FKBP, PIP5K | 10.6 |
| 424707 | BE061914 | Hs. 10844 | Homo sapiens cDNA FLJ14476 fis | SS, SS, TM, Sema | 10.6 |
| 416819 | U77735 | Hs. 80205 | pim-2 oncogene | pkinase, SS, TM, OTU, K_tetra | 10.5 |
| 419341 | N71463 | Hs. 118888 | ESTs, Weakly similar to ALU1_H | SS, TM, UPF0016 | 10.5 |
| 444359 | AI697160 | Hs. 143594 | ESTs, Weakly similar to HS4L_H | | 10.5 |
| 404333 | | | C7001735* gi|7768636|dbj|BAA95 | vwd | 10.5 |
| 401210 | | | C12000519 gi|7710046|ref|NP_05 | | 10.5 |
| 457941 | AI004525 | Hs. 14587 | ESTs, Weakly similar to AF1518 | SS, TM, SS, TM | 10.4 |
| 401594 | | | NM_024817. Homo sapiens hypothe | | 10.3 |
| 441790 | AW294909 | Hs. 132208 | ESTs | | 10.3 |
| 444008 | BE544855 | Hs. 236572 | ESTs, Weakly similar to SFR4_H | SS, SS, SAC3_GANP | 10.3 |
| 438185 | Y19188 | Hs. 320461 | ESTs | SS | 10.2 |
| 432031 | AF039196 | Hs. 272367 | hairless protein (putative sin | jmjC | 10.2 |
| 410471 | T88872 | | gb: yd31a12 s1 Soares fetal liv | | 10.1 |
| 433573 | AF234887 | Hs. 57652 | cadherin, EGF LAG seven-pass G | SS, TM, 7tm_2, EGF, cadherin, | 10.1 |
| 417371 | N74613 | Hs. 269149 | ESTs | | 10.0 |
| 428167 | AA770021 | Hs. 16332 | ESTs | SS, ig, fn3 | 10.0 |
| 419563 | AA526235 | Hs. 193162 | Homo sapiens cDNA FLJ11983 fis | | 10.0 |
| 412674 | X04106 | Hs. 74451 | calpain 4, small subunit (30 K) | efhand, SS, CAP_GLY | 10.0 |
| 425863 | U43604 | Hs. 159901 | Human unidentified mRNA, parti | | 9.9 |
| 442739 | NM_007274 | Hs. 8679 | cytosolic acyl coenzyme A thio | Acyl-CoA_hydro, SS, TM | 9.9 |
| 429469 | AA64590 | Hs. 27 | glycine dehydrogenase (decarbo | GDC-P, GDC-P | 9.9 |
| 420029 | BE258876 | Hs. 94446 | polyamine-modulated factor 1 | aldo_ket_red, SS, TM, gla | 9.8 |
| 445625 | BE246743 | | hypothetical protein FLJ22635 | SS, TM | 9.8 |
| 435339 | AI358300 | | ESTs | SS, ras | 9.8 |
| 407235 | D20569 | Hs. 169407 | SAC2 (suppressor of actin muta | SS, TM, Ribosomal_S13, Galac | 9.8 |
| 428758 | AA433988 | Hs. 98502 | CA125 antigen, mucin 16 | SS | 9.8 |
| 401349 | | | inositol polyphosphate-1-phosp | | 9.7 |
| 437915 | AI637993 | Hs. 202312 | Homo sapiens clone N11 NTera2D | | 9.7 |
| 424511 | BE300512 | Hs. 193657 | ESTs, Moderately similar to AL | | 9.7 |
| 423366 | Z80345 | Hs. 127610 | acyl-Coenzyme A dehydrogenase | Acyl-CoA_dh, Acyl-CoA_dh_M | 9.7 |
| 405143 | | | NM_013432* homo sapiens nuclea | ank, SS, TM, CPSF_A | 9.6 |
| 427497 | AW139476 | Hs. 31240 | ESTs | | 9.6 |
| 420423 | AA827718 | Hs. 88218 | ESTs | SS | 9.6 |
| 431512 | BE270734 | Hs. 2795 | lactate dehydrogenase A | Idh, Idh_C, SS, Idh | 9.6 |
| 450052 | AI681298 | Hs. 236524 | ESTs | zf-C3HC4, zf-B_box | 9.5 |
| 412738 | N34731 | Hs. 74562 | siah binding protein 1, FBP in | homeohox | 9.5 |
| 444202 | AL031685 | Hs. 12785 | KIAA0939 protein | SS, TM, Na_H_Exchanger, ABC2 | 9.5 |
| 451165 | AI340575 | Hs. 286084 | MRIP-1 protein | | 9.5 |
| 411450 | H49619 | Hs. 127301 | ESTs | SS, pkinase | 9.5 |
| 405371 | | | NM_005569* Homo sapiens LIM do | pkinsoe, LIM, PDZ | 9.5 |
| 435782 | N49433 | Hs. 285737 | homo sapiens cDNA: FLJ20895 fi | SS, G6PD, Glucosamine_iso, G | 9.5 |
| 416866 | AA297356 | Hs. 80324 | serine/threonine protein phosp | Metallophos, Metallophos | 9.4 |
| 405474 | | | NM_001093* homo sapiens acetyl | CPSase_L_chain, biotin_lip | 9.4 |
| 412837 | AI922293 | Hs. 58389 | hypothetical protein MGC4090 | | 9.3 |
| 448133 | AA723157 | Hs. 73769 | folate receptor 1 (adult) | Folate_rec, SS | 9.3 |
| 431081 | AA491594 | Hs. 75813 | polycystic kidney disease 1 (a | SS, TM | 9.3 |
| 427640 | AF058293 | Hs. 180015 | D-dopachrome tautomerase | MIF, late_protein_L2, SS, GS | 9.2 |

TABLE 14A-continued

| Pkey | ExAccn | UniGene ID | Unigene Title | Pred Protein Dom | R1 |
|---|---|---|---|---|---|
| 427435 | AW938739 | Hs. 115412 | hypothetical protein FLJ13881 | SS | 9.2 |
| 407688 | W25317 | Hs. 37616 | Human D9 splice variant B mRNA | | 9.2 |
| 407507 | U73799 | | gb: Haman dynactin mRNA, partia | SS, TM, HCO3_cotransp, CAP_G | 9.2 |
| 400833 | | | C11000890 gi3746443gbAAC639 | SS, TM, 7tm_1 | 9.2 |
| 422064 | AW452589 | Hs. 335742 | ESTs | TM | 9.2 |
| 452434 | D30934 | Hs. 29549 | C-type lectin-like receptor-1 | lectin_c, SS, TM | 9.2 |
| 451752 | AB032997 | | KIAA1171 protein | TBC, SS, TM, pkinase, laminin | 9.2 |
| 432931 | AF174487 | Hs. 293753 | Bcl-2-related ovanan killer p | | 9.1 |
| 407893 | BE408359 | Hs. 43621 | *Homo sapiens*, Similar to hypot | SS, SS, arf, ras, fn3, ras | 9.1 |
| 427397 | AI929685 | Hs. 177656 | calmodulin 1 (phosphorylase ki | efhand, RrnaAD, SS, efhand | 9.1 |
| 405159 | | | ENSP00000243337* CDNA FLJ13984 | | 9.1 |
| 422283 | AW411307 | Hs. 114311 | CDC45 (cell division cycle 45, | CDC45 | 9.1 |
| 407058 | X94563 | | gb: *H. sapiens* dbi/acbp gene exo | SS | 9.0 |
| 448045 | AJ297436 | Hs. 20166 | prostate stem cell antigen | SS, TM, UPAR_LY6, toxin, SS, T | 9.0 |
| 400772 | | | NM_003105*: homo sapiens sortil | Idl_recept_a, fn3, Idl_rece | 9.0 |
| 427315 | AA179949 | Hs. 175563 | homo sapiens mRNA, cDNA DKFZp5 | spectrin, SH3, PH, CH | 9.0 |
| 414391 | BE409872 | | gb: 601299655F1 NIH_MGC_21 Homo | | 9.0 |
| 447867 | AI525268 | Hs. 164303 | ESTs | TM | 9.0 |
| 422639 | AI929377 | Hs. 173724 | creatine kinase, brain | ATP-gua_Ptrans, ATP-gua_Pt | 9.0 |
| 454319 | AW247736 | Hs. 101617 | ESTs, Weakly similar to T32527 | SS | 8.9 |
| 428781 | AF164799 | Hs. 193384 | putatatine 28 kDa protein | | 8.9 |
| 408645 | AW245738 | Hs. 109274 | hypothetical protein MGC4365 | SS, TM | 8.9 |
| 429527 | AA454184 | Hs. 289014 | ESTs | | 8.9 |
| 406651 | AI559224 | | gb: tq32c02.x1 NCI_CGAP_Ut1 Hom | | 8.9 |
| 430893 | BE502068 | Hs. 282067 | ESTs | | 8.8 |
| 414413 | BE294877 | | gb: 601174162F1 NIH_MGC_17 Homo | SS | 8.8 |
| 413726 | AJ278465 | Hs. 75510 | annexin A11 | annexin, SS, annexin | 8.8 |
| 432211 | BE274530 | Hs. 273333 | hypothetical protein FLJ10986 | | 8.8 |
| 421694 | BE387430 | Hs. 106880 | bystin-like | | 8.8 |
| 453683 | AL079854 | Hs. 118598 | homo sapiens mRNA for KIAA1878 | SS | 8.8 |
| 456741 | W37608 | Hs. 184492 | ESTs | SS, pkinase | 8.7 |
| 442995 | AA532511 | Hs. 288455 | homo sapiens cDNA FLJ23270 fi | | 8.7 |
| 415898 | Z43379 | Hs. 177193 | gb: HSC1AE111 normalized infant | | 8.7 |
| 456977 | AK000252 | Hs. 169758 | hypothetical protein FLJ20245 | | 8.7 |
| 439632 | AW410714 | Hs. 334437 | hypothetical protein MGC4248 | SS, TM, transmembrane4 | 8.7 |
| 431462 | AW583672 | Hs. 256311 | granin-like neuroendocrine pep | SS | 8.7 |
| 400128 | | | Eos Control | TM, E1–E2_ATPase, NMA, Hydro | 8.7 |
| 438582 | AI521310 | Hs. 283365 | ESTs, Weakly similar to ALU5_H | SS | 8.7 |
| 450958 | AL137669 | Hs. 348012 | homo sapiens mRNA, cDNA DKFZp4 | | 8.7 |
| 410855 | X97795 | Hs. 66718 | RAD54 (*S. cerevisiae*)-like | SNF2_N, helicase_C, SS | 8.7 |
| 415126 | D60945 | | gb: HUM141D04B Clontech human f | SS, TM | 8.7 |
| 418736 | T18979 | Hs. 87908 | Snf2-related CBP activator pro | SS, helicase_C, AT_hook, SS, | 8.6 |
| 431157 | AI823969 | Hs. 132678 | ESTs | SS, MAPEG, SS, MAPEG | 8.6 |
| 418843 | AJ251016 | Hs. 89230 | potassium intermediate/small c | TM, CaMBD, SK_channel, TM | 8.6 |
| 419167 | AI589535 | Hs. 94875 | ESTs, Weakly similar to A35363 | SS | 8.6 |
| 432343 | NM_002960 | Hs. 2961 | S100 calcium-binding protein A | S_100, SS, efhand, S_100 efh | 8.6 |
| 458440 | AI095468 | Hs. 135254 | *Homo sapiens* clone 1 thrombosp | | 8.6 |
| 407065 | Y10141 | | gb: *H. sapiens* DAT1 gene, partia | SNF, SS, TM | 8.6 |
| 452851 | AW173191 | Hs. 213117 | ESTs | SS, Sema | 8.6 |
| 422418 | AK001383 | Hs. 116385 | hypothetical protein FLJ10521 | RhoGEF | 8.6 |
| 420836 | AW958453 | Hs. 204959 | hypothetical protein FLJ14886 | SS, ras | 8.6 |
| 455588 | AI129903 | Hs. 74679 | vesicle-associated membrane pr | synaptobrevin, SS, TM | 8.5 |
| 431974 | AW972689 | Hs. 200934 | ESTs | bZIP | 8.5 |
| 410720 | AF035154 | Hs. 65756 | regulator of G-protein signall | RGS, G-gamma, DEP, SS, RGS, DI | 8.5 |
| 449751 | AW207115 | Hs. 25555 | ESTs | | 8.5 |
| 434030 | AW162336 | Hs. 3709 | low molecular mass ubiquinone- | SS | 8.5 |
| 405557 | | | Target Exon | Ets, SAM_PNT | 8.5 |
| 443780 | NM_012068 | Hs. 9754 | activating transcription facto | bZIP, NTP_transf_2, SS, TBC | 8.5 |
| 428860 | U38291 | Hs. 194301 | microtubule-associated protein | M | 8.5 |
| 421901 | AB014554 | Hs. 109299 | protein tyrosine phosphatase, | SAM, SS, TM, rrm, PDZ | 8.4 |
| 401885 | | | Target Exon | kinesin, SS, TM | 8.4 |
| 449382 | AI650407 | Hs. 197875 | ESTs | SS, rrm, zt-RanBP | 8.4 |
| 432862 | AW004958 | Hs. 236720 | amnionless protein | SS, MATH, zf-TRAF, zf-C3HC4 | 8.4 |
| 441363 | AW450211 | Hs. 126825 | ESTs, Weakly similar to A46302 | SS, TM, HSP20, 7tm_1 | 8.4 |
| 407363 | AF035032 | Hs. 181125 | gb: *Homo sapiens* clone MCA1L my | SS, ig, SS, G_glu_transpept | 8.4 |
| 425380 | AA356389 | Hs. 32148 | AD-015 protein | SS, TM, LRR, P, Peptidase_S8 | 8.4 |
| 424893 | AW295112 | Hs. 153648 | *Homo sapiens* cDNA FLJ13303 fis | SS, SAM, SS, TM, 7tm_1 | 8.4 |
| 424080 | AW189983 | Hs. 139119 | *Homo sapiens* cDNA FLJ10967 fis | | 8.3 |
| 439772 | AL365406 | Hs. 10268 | *Homo sapiens* mRNA full length | | 8.3 |
| 431765 | AF124249 | Hs. 268541 | novel SH2-containing protein 1 | SH2, SS, TM | 8.3 |
| 404365 | | | Target Exon | SS | 8.3 |
| 424310 | AA338648 | Hs. 50334 | testes development-related NYD | SS, TM | 8.3 |
| 401935 | | | Target Exon | PH | 8.3 |
| 434796 | AA812046 | | ESTs | SS, myb_DNA-binding.myb_DN | 8.3 |
| 423098 | AA321980 | Hs. 204682 | ESTs | | 8.3 |
| 434552 | AA639618 | Hs. 325116 | *Homo sapiens*, clone MGC: 2962, | SS | 8.2 |
| 457082 | AA470687 | Hs. 104772 | ESTs | SS | 8.2 |

TABLE 14A-continued

| Pkey | ExAccn | UniGene ID | Unigene Title | Pred Protein Dom | R1 |
|---|---|---|---|---|---|
| 432603 | AA554920 | Hs. 105794 | UDP-glucose: glycoprotein gluco | SS, TM | 8.2 |
| 402445 | | | Target Exon | fn3, SS, TM, BNR | 8.2 |
| 422078 | AW872378 | Hs. 120170 | hypothetical protein FLJ21415 | SS | 8.2 |
| 418361 | AW505368 | Hs. 12460 | gb: UI-HF-BN0-alu-d-03-0-UI.r1 | | 8.2 |
| 431354 | BE046956 | Hs. 251673 | DNA (cytosine-5-)-methyltransf | SS, PWWP, PHD | 8.2 |
| 403885 | | | Target Exon | TM, Sulfate_transp, STAS, HM | 8.2 |
| 450029 | AW073380 | Hs. 267963 | hypothetical protein FLJ10535 | SS, Pyridox_oxidase, zf-C2H | 8.2 |
| 452512 | AW363486 | Hs. 337635 | ESTs | SS | 8.2 |
| 420138 | BE268854 | Hs. 177729 | ESTs | SS | 8.2 |
| 439788 | N71241 | Hs. 119275 | ESTs | UQ_con | 8.2 |
| 423662 | AK001035 | Hs. 130881 | B-cell CLL/lymphoma 11A (zinc | SS | 8.2 |
| 449656 | AA002008 | Hs. 188633 | ESTs | PIP5K | 8.1 |
| 452295 | BE379936 | Hs. 28866 | programmed cell death 10 | SS, serpin | 8.1 |
| 448650 | AW769385 | Hs. 204891 | ESTs | SS, IL8 | 8.1 |
| 446035 | NM_006558 | Hs. 13565 | Sam68-like phosphotyrosine pro | KH-domain | 8.1 |
| 444406 | AI147237 | | immunoglobulin heavy constant | SS | 8.1 |
| 437215 | AL117488 | | Human clone 23564 mRNA sequenc | SS | 8.1 |
| 408891 | NM_006577 | Hs. 284284 | ESTs, Highly similar to beta-1 | SS, TM, DIX, PDZ, DEP, Disheve | 8.1 |
| 400409 | AF153341 | | Homo sapiens winged helix/fork | SS | 8.0 |
| 443801 | AW206942 | Hs. 253594 | intron of trichothinophalang | GATA | 8.0 |
| 425281 | AA444390 | Hs. 155482 | hydroxyacyl glutathione hydrol | lactamase_B, SS | 8.0 |
| 458216 | AW024282 | Hs. 104938 | hypothetical protein MGC15906 | | 8.0 |
| 401507 | | | C15000810* gi|11131272|sp|P793 | | 8.0 |
| 401180 | | | eukaryotic translation elongat | SS, TM, ion_trans, IQ | 8.0 |
| 454291 | AW384847 | Hs. 213534 | ESTs, Weakly similar to MUC2_H | SS, XRCC1_N, BRCT, lactamase | 8.0 |
| 444014 | AI095718 | Hs. 135015 | ESTs | | 8.0 |
| 412128 | AW894709 | | gb: CM1-NN0032-020500-212-d05 N | SCAN, zf-C2H2, KRAB | 7.9 |
| 408363 | NM_003389 | Hs. 44396 | coronin, actin-binding protein | WD40 | 7.9 |
| 425694 | U51333 | Hs. 159237 | hexokinase 3 (white cell) | hexokinase, hexokinase2, he | 7.9 |
| 425263 | NM_001197 | Hs. 155419 | BCL2-interacting killer (apopt | SS, TM, TspQ_MBR | 7.9 |
| 447045 | AW392394 | | sorting nexin 17 | SS, IF-2B, PP2C | 7.9 |
| 457613 | AA598869 | Hs. 173770 | ESTs | | 7.9 |
| 410338 | W03445 | Hs. 38205 | gb: za05g11 r1 Soares melanocyt | pkinase | 7.9 |
| 402545 | | | Target Exon | | 7.9 |
| 454246 | AW245185 | Hs. 6996 | ESTs | | 7.9 |
| 410079 | U94362 | Hs. 58589 | glycogenin 2 | Glyco_transf_8 | 7.9 |
| 443678 | AW009605 | Hs. 231923 | ESTs | SS | 7.9 |
| 404676 | | | Target Exon | | 7.9 |
| 406649 | AI569392 | | gb: tn86a02 x1 NCI_CGAP_Ut2 Hom | | 7.9 |
| 420230 | AL034344 | Hs. 284186 | forkhead box C1 | Fork_head, SS, Fork_head | 7.9 |
| 413534 | BE146961 | | gb: QV4-HT0222-011199-019-b12 H | SS, TM | 7.8 |
| 444628 | U01120 | Hs. 242 | glucose-6-phosphatase, catalyt | PAP2, SS, TM | 7.8 |
| 410839 | NM_006849 | Hs. 66581 | protein disulfide isomerase | thiored, Rho_GDI, gntR, SS, T | 7.8 |
| 444046 | AI360834 | Hs. 135094 | ESTs | SS, GTP_EFTU, EFG_C, GTP_EFT | 7.8 |
| 439501 | AF086321 | Hs. 287452 | Homo sapiens cDNA FLJ11760 fis | TM | 7.8 |
| 415441 | R13977 | Hs. 9634 | ESTs | | 7.8 |
| 450461 | BE408081 | Hs. 46736 | hypothetical protein FLJ23476 | SS | 7.8 |
| 448993 | AI471630 | | KIAA0144 gene product | | 7.8 |
| 400923 | | | Target Exon | SS, TM, DUF289 | 7.8 |
| 440546 | AI491994 | | gb: to07g09 x1 NCI_CGAP_Ut2 Hom | SS, HATPase_c | 7.8 |
| 419757 | AA773820 | Hs. 63970 | ESTs | SS, TM | 7.8 |
| 451721 | NM_006946 | Hs. 26915 | spectrin, beta, non-erythrocyt | spectrin, PH, CH, SS, Peptida | 7.8 |
| 458834 | AI566883 | Hs. 196446 | ESTs | | 7.8 |
| 422633 | X56832 | Hs. 118804 | enolase 3, (beta, muscle) | enolase, SS, TM, kinesin, FHA | 7.7 |
| 438452 | AI220911 | Hs. 288959 | hypothetical protein FLJ20920 | SS | 7.7 |
| 421445 | AA913059 | Hs. 104433 | Homo sapiens, clone IMAGE 4054 | asp, SS, TM, ion_trans, K_tet | 7.7 |
| 434743 | AI363410 | | ribosomal protein S18 | SS, TM | 7.7 |
| 450635 | AW403954 | Hs. 25237 | mesenchymal stem cell protein | 4HBT | 7.7 |
| 442394 | R62926 | Hs. 285193 | ESTs | | 7.7 |
| 434333 | AA186733 | Hs. 292154 | stromal cell protein | | 7.7 |
| 427221 | L15409 | Hs. 174007 | von Hippel-Lindau syndrome | VHL, TM | 7.7 |
| 429099 | BE439952 | Hs. 196177 | phosphorylase kinase, gamma 2 | pkinase, SS, SNF2_N, helicas | 7.7 |
| 444670 | H58373 | Hs. 332938 | hypothetical protein MGC5370 | SS, zf-RanBP, MDM2 | 7.7 |
| 449495 | AI652833 | | gb: wb22c11 x1 NCI_CGAP_GC6 Hom | SS | 7.7 |
| 444607 | AW405635 | Hs. 293687 | ESTs | SS, PI-PLC-X, PH, PI-PLC-Y, C | 7.7 |
| 449125 | AI671439 | Hs. 196029 | Homo sapiens mRNA for KIAA1657 | TIMP | 7.7 |
| 447151 | AI022813 | Hs. 92679 | Homo sapiens clone CDABP0014 m | SS, TM, LRR, aminotran_1_2 | 7.6 |
| 448626 | W27670 | Hs. 55613 | hypothetical protein FLJ22531 | | 7.6 |
| 430432 | AB037758 | Hs. 241419 | KIAA1337 protein | TM, Patched, TM | 7.6 |
| 401822 | | | C17001422: gi|2695866|emb|CAA75 | | 7.6 |
| 428909 | AI190714 | Hs. 98945 | ESTs | | 7.6 |
| 414534 | BE257293 | Hs. 76366 | BCL2-antagonist of cell death | SS, hormone_rec, zf-C4 | 7.6 |
| 421620 | AA446183 | Hs. 91885 | ESTs, Weakly similar to I55214 | | 7.6 |
| 441650 | AI261960 | Hs. 132545 | ESTs | SS, TM, KOW | 7.6 |
| 442232 | AI357813 | Hs. 337460 | ESTs, Weakly similar to A47582 | SS, TM, TGFb_propeptide, TGF | 7.6 |
| 439539 | BE348395 | Hs. 121589 | ESTs | SS, Fork_head | 7.5 |
| 400286 | | | C16000922 gi|7499103|pir||T209 | TM ABC_tran, ABC_membrane | 7.5 |

TABLE 14A-continued

| Pkey | ExAccn | UniGene ID | Unigene Title | Pred Protein Dom | R1 |
|---|---|---|---|---|---|
| 452833 | BE559681 | Hs. 30736 | KIAA0124 protein | WD40 | 7.5 |
| 417390 | AA196552 | Hs. 85852 | hypothetical protein MGC3169 | | 7.5 |
| 427721 | AI582843 | Hs. 180455 | RAD23 (*S. cerevisiae*) homolog | ubiquitin, UBA, integrin_B, | 7.5 |
| 450716 | T57758 | Hs. 10255 | ESTs | | 7.5 |
| 407435 | AF211976 | | gb: *Homo sapiens* LENG9 mRNA, pa | | 7.5 |
| 413956 | AI821351 | Hs. 193133 | ESTs, Weakly similar to ALU7_H | | 7.5 |
| 427899 | AA829286 | Hs. 332053 | serum amyloid A1 | SS, SAA_proteins, SS, SAA_pr | 7.5 |
| 406495 | | | Target Exon | SRCR, TM, Acetyltransf | 7.5 |
| 430387 | AW372884 | Hs. 240770 | nuclear cap binding protein su | rrm, SS, TM, rrm | 7.5 |
| 408601 | U47928 | Hs. 86122 | protein A | SS, 7tm_1, SS, ig, WD40, zf-UB | 7.5 |
| 424364 | AW383226 | Hs. 163834 | ESTs, Weakly similar to G01763 | SS, ras | 7.4 |
| 409832 | AW963293 | | gb: EST375366 MAGE resequences, | SS | 7.4 |
| 448043 | AI458653 | Hs. 201881 | ESTs | PHD | 7.4 |
| 421148 | AF008936 | Hs. 102178 | syntaxin 16 | Syntaxin, SS, Peptidase_M17 | 7.4 |
| 420970 | AA305079 | Hs. 1342 | cytochrome c oxidase subunit V | COX5B | 7.4 |
| 419295 | BE397712 | Hs. 144027 | ESTs | myb_DNA-binding, myh_DNA-b | 7.4 |
| 448330 | AL036449 | | ESTs | | 7.4 |
| 419639 | AK001502 | Hs. 91753 | hypothetical protein | | 7.4 |
| 431488 | AB037785 | Hs. 257594 | KIAA1364 protein | SS, CH, LIM, SS | 7.4 |
| 456487 | AF064804 | | suppressor of Ty (*S. cerevisiae* | | 7.4 |
| 448615 | AI910868 | Hs. 212957 | ESTs | SS | 7.4 |
| 427433 | D82070 | Hs. 177972 | chromosome 4 open reading fram | SS, pkinase | 7.4 |
| 441076 | N49809 | Hs. 11197 | *Homo sapiens*, clone IMAGE 3343 | | 7.4 |
| 452554 | AW452434 | Hs. 58006 | ESTs, Weakly similar to ALU5_H | SS, PAS, HLH | 7.4 |
| 411448 | AA178955 | Hs. 271439 | ESTs, Weakly similar to I38022 | rrm, PDZ | 7.4 |
| 442318 | AI792199 | | ESTs | SS, zf-C2H2 | 7.4 |
| 425055 | AW961959 | Hs. 96940 | ESTs | | 7.4 |
| 412935 | BE267045 | Hs. 75064 | tubulin-specific chaperone c | SS, TM, transmembrane4 | 7.4 |
| 403748 | | | Target Exon | TM | 7.4 |
| 447282 | AI989963 | Hs. 197505 | ESTs | TM | 7.3 |
| 422305 | AI928242 | Hs. 293438 | ESTs, Highly similar to AF1984 | SS | 7.3 |
| 416472 | AA180756 | Hs. 340316 | ESTs, Moderately similar to AL | zf-C2H2 | 7.3 |
| 427273 | AW139032 | Hs. 107376 | hypothetical protein DKFZp434N | SS, SS, TM | 7.3 |
| 412265 | AA101325 | Hs. 86154 | hypothetical protein FLJ12457 | UPP_synthetase, HMG14_17 | 7.3 |
| 447859 | AK002194 | Hs. 19851 | peroxisomal biogenesis factor | | 7.3 |
| 432747 | NM_014404 | Hs. 278907 | calcium channel, voltage-depen | PMP22_Claudin, SS, TM, PMP22 | 7.3 |
| 406727 | AI219282 | Hs. 2186 | eukaryotic translation elongat | SS, G-gamma | 7.3 |
| 404199 | | | ENSP00000211797*: Helicase SK12 | SS, RasGAP, PH, SS, PHD | 7.3 |
| 445434 | BE391690 | Hs. 9265 | hypothetical protein FLJ20917 | SS, PWWP, Exonuclease, lipoc | 7.2 |
| 428550 | AW297880 | Hs. 98661 | ESTs | SS, homeobox, homeobox | 7.2 |
| 454718 | AW815144 | | gb: QV4-ST0212-120100-075-d10 S | SS, ATP-synt_ab, ATP-synt_a | 7.2 |
| 407686 | AW901268 | Hs. 126043 | chromosome 21 open reading fra | SS, TM, ISK_Channel | 7.2 |
| 418304 | AA215702 | | gb: zr97g10.r1 NCI_CGAP_GCB1 Ho | serpin | 7.2 |
| 424263 | M77640 | Hs. 1757 | L1 cell adhesion molecule (hyd | fn3, ig, IRK, SS, TM, fn3, ig, R | 7.2 |
| 407581 | R48402 | Hs. 173508 | P3ECSL | SS, TM, 7tm_1 | 7.2 |
| 430746 | AW977370 | Hs. 222012 | ESTs | SS | 7.2 |
| 402651 | | | NM_000721* *Homo sapiens* calciu | ion_trans | 7.2 |
| 407323 | AA181183 | Hs. 143504 | gb: zp57c02.s1 Stratagene endot | SS, Ribosomal_S4e, ubiquiti | 7.2 |
| 407619 | AL050341 | Hs. 37165 | collagen, type IX, alpha 2 | SS, Collagen, SS, Collagen | 7.2 |
| 434035 | AI762074 | Hs. 204769 | ESTs, Weakly similar to T28770 | SS, TM | 7.2 |
| 400419 | AF084545 | | Target | EGF, ig, lectin_c, sushi, Xli | 7.2 |
| 424241 | AW995948 | Hs. 182339 | *Homo sapiens* pyruvate dehydrog | SAM_PNT | 7.2 |
| 445837 | AI261700 | | ESTs | | 7.2 |
| 427725 | U66839 | Hs. 180533 | mitogen-activated protein kina | pkinase | 7.1 |
| 421879 | AW959607 | | gb: EST371677 MAGE resequences, | | 7.1 |
| 418285 | H68616 | Hs. 293756 | ESTs | SS, EMP24_GP25L | 7.1 |
| 442893 | H78133 | | gb: yu86c11.s1 Soares fetal liv | | 7.1 |
| 437829 | AI358522 | Hs. 103834 | ESTs | | 7.1 |
| 450873 | BE464016 | Hs. 238956 | ESTs | SS, zf-C2H2, rrm | 7.1 |
| 433396 | AI742071 | Hs. 133205 | ESTs | SS, TM | 7.1 |
| 415595 | R54144 | Hs. 278707 | chromosome 21 open reading fra | SS | 7.1 |
| 436629 | AA861011 | Hs. 249795 | ESTs | TM | 7.1 |
| 414593 | BE386764 | | gb: 601273249F1 NIH_MGC_20 Homo | | 7.1 |
| 422756 | AW409701 | Hs. 1578 | baculoviral IAP repeat-contain | BIR, TK, SS, TM | 7.1 |
| 419823 | AW271708 | Hs. 118918 | ESTs, Weakly similar to M2OM_H | SS, TM | 7.1 |
| 405247 | | | Target Exon | SS | 7.1 |
| 455778 | BE088746 | | gb: CM2-BT0693-210300-123-d09 B | | 7.1 |
| 431005 | AA490544 | Hs. 127269 | ESTs, Weakly similar to T02345 | WD40 | 7.1 |
| 435717 | AF227905 | Hs. 105794 | UDP-glucose glycoprotein gluco | Glyco_transf_8 | 7.1 |
| 405113 | | | Target Exon | SS | 7.1 |
| 428070 | T63918 | Hs. 182313 | retinol-binding protein 2, cel | lipocalin, lipocalin, WD40 | 7.1 |
| 429029 | AA443443 | Hs. 85524 | for muscle specific ring finge | SS | 7.1 |
| 430354 | AA954810 | Hs. 239784 | human homolog of Drosophila Sc | SS, TM, ig | 7.0 |
| 412970 | AB026436 | Hs. 177534 | dual specificity phosphatase 1 | Rhodanese, DSPc, SS, DSPc | 7.0 |
| 438701 | AA937112 | Hs. 207788 | ESTs | TM, sushi | 7.0 |
| 454756 | AW819273 | | gb: CM2-ST0284-061299-046-a12 S | | 7.0 |
| 401264 | | | C18000090*: gi|6678656|ref|NP_0 | SS, laminin_Nterm, laminin_ | 7.0 |

TABLE 14A-continued

| Pkey | ExAccn | UniGene ID | Unigene Title | Pred Protein Dom | R1 |
|---|---|---|---|---|---|
| 408080 | AW149754 | Hs. 248652 | ESTs, Weakly similar to T00273 | SS | 7.0 |
| 418641 | BE243136 | Hs. 86947 | a disintegrin and metalloprote | disintegrin, Reprolysin, Pe | 7.0 |
| 431402 | AA743534 | Hs. 250861 | ESTs | | 7.0 |
| 423790 | BE152393 | | gb: CM2-HT0323-171199-033-a08 H | SS | 7.0 |
| 450688 | AW272352 | Hs. 60450 | ESTs | TM | 7.0 |
| 405928 | | | Target Exon | SS, cystatin, Coprogen_oxid | 7.0 |
| 454438 | AA224053 | | cell division cycle 27 | SS, TM, SPRY, 7tm_3, _ANF_rece | 7.0 |
| 407281 | AI307226 | Hs. 164421 | ESTs | SS | 6.9 |
| 423386 | AW136098 | Hs. 314081 | ESTs | SS, WD40, EPO_TPO | 6.9 |
| 459360 | BE384526 | Hs. 25734 | gb: 601277913F1 NIH_MGC_20 Homo | | 6.9 |
| 420187 | AK001714 | Hs. 95744 | hypothetical protein similar t | ank, TM | 6.9 |
| 431549 | AA507036 | Hs. 170673 | ESTs | | 6.9 |
| 423384 | AL133632 | Hs. 127808 | Homo sapiens mRNA, cDNA DKFZp4 | | 6.9 |
| 454577 | AW809272 | | gb: MR4-ST0118-040100-034-c08_1 | | 6.9 |
| 438118 | AW753311 | | ESTs | SS lipocalin | 6.9 |
| 416233 | AA176633 | | gb: zp13g01 s1 Stratagene fetal | | 6.9 |
| 417012 | N38970 | Hs. 194214 | ESTs | | 6.9 |
| 452399 | BE513301 | Hs. 29344 | hypothetical protein, clone 24 | SS, perilipin | 6.9 |
| 439963 | AW247529 | Hs. 6793 | platelet-activating factor ace | PAF-AH_Ib, Lipase_GDSL, SS, | 6.9 |
| 418416 | U11700 | Hs. 84999 | ATPase, Cu transporting, beta | E1–E2_ATPase, HMA, Hydrolas | 6.9 |
| 404956 | | | C1003210* gi|6912582|ref|NP_03 | PI3_PI4_kinase, PI3K_C2 PI | 6.9 |
| 451606 | AA018791 | Hs. 7945 | AIE-75 binding protein protein | SS | 6.9 |
| 438525 | AW368528 | Hs. 100855 | ESTs | SS | 6.9 |
| 400906 | | | C18000324 gi|12229928|sp|Q9PTW | | 6.9 |
| 411411 | AA345241 | Hs. 55950 | ESTs, Weakly similar to KIAA13 | SS | 6.8 |
| 406834 | AI318680 | | gb: ta49g09 x1 NCI_CGAP_Lu25 Ho | | 6.8 |
| 414629 | AA345824 | Hs. 76688 | carboxylesterase 1 (monocyte/m | SS, COesterase, SS, COestera | 6.8 |
| 424198 | AB029010 | Hs. 143026 | KIAA1087 protein | SS, TM, Na_Ca_Ex, Calx-beta, | 6.8 |
| 445873 | AA250970 | Hs. 251946 | poly(A)-binding protein, cytop | SS, PABP, rrm, pkinase, 14-3- | 6.8 |
| 439605 | AF086431 | Hs. 22380 | ESTs | SS, TM | 6.8 |
| 432284 | AA532807 | Hs. 105822 | ESTs | SS, TM, pkinase | 6.8 |
| 421904 | BE143533 | Hs. 109309 | hypothetical protein FLJ20035 | | 6.8 |
| 443136 | NM_001440 | Hs. 9018 | exostoses (multiple)-like 3 | Exostosin, SS, TM | 6.8 |
| 421758 | BE397336 | Hs. 1422 | Gardner-Rasheed feline sarcoma | SH2, SH3, pkinase | 6.8 |
| 448148 | NM_016578 | Hs. 20509 | HBV pX associated protein-8 | PHD, Virus_HS, SS, ICln_chan | 6.8 |
| 400205 | | | NM_006265* Homo sapiens RAD21 | SS | 6.8 |
| 434315 | AW196608 | | ESTs | | 6.8 |
| 418184 | AA367375 | | Homo sapiens cDNA FLJ14015 fis | | 6.8 |
| 431898 | AK000020 | Hs. 272018 | hypothetical protein FLJ20013 | | 6.7 |
| 438627 | AI087335 | Hs. 123473 | ESTs | TM, Reticulon | 6.7 |
| 409649 | AA159216 | Hs. 55505 | hypothetical protein FLJ20442 | Y_phosphatase, DSPc, TM | 6.7 |
| 429712 | AW245825 | Hs. 211914 | ENSP00000233627* NADH-ubiquino | oxidored_q6, SS, TM, rrm | 6.7 |
| 456866 | AW089093 | Hs. 144996 | ESTs, Weakly similar to I38022 | | 6.7 |
| 427461 | AA531527 | Hs. 332040 | hypothetical protein MGC13010 | SS, TM, ACAT, LRR | 6.7 |
| 434000 | BE002846 | Hs. 112964 | ESTs | | 6.7 |
| 432530 | AF131786 | Hs. 278303 | Homo sapiens clone 25220 mRNA | SS, proteasome | 6.7 |
| 436141 | AA970001 | Hs. 150319 | Homo sapiens, clone IMAGE 3610 | SS, TM | 6.7 |
| 441794 | AW197794 | | ESTs | | 6.7 |
| 450287 | AW291483 | Hs. 255909 | ESTs | | 6.7 |
| 441523 | AW514263 | | ESTs, Weakly similar to ALUF_H | SS | 6.7 |
| 452798 | AI918771 | Hs. 257170 | ESTs | SS, TM, TNFR_c6 | 6.7 |
| 451937 | AF119664 | Hs. 27299 | transcriptional regulator prot | SS, integrin_B, fn3, Calx-be | 6.7 |
| 421417 | AA291004 | Hs. 326088 | ESTs | | 6.7 |
| 440317 | BE561888 | | gb: 601346093F1 NIH_MGC_8 Homo | | 6.7 |
| 421321 | NM_005309 | Hs. 103502 | glutamic-pyruvate transaminase | aminotran_1_2, SS, TM, LRR | 6.7 |
| 444904 | AW452054 | Hs. 161139 | ESTs | | 6.7 |
| 449730 | R72290 | Hs. 117557 | ESTs, Weakly similar to I38022 | RasGAP, thyroglobulin_1, Ri | 6.7 |
| 450622 | AI660285 | Hs. 58210 | ESTs, Highly similar to ITH4_H | SS, TM, vwa | 6.7 |
| 425424 | NM_004954 | Hs. 157199 | ELKL motif kinase | pkinase, KA1, UBA, SS | 6.7 |
| 435864 | AL036499 | Hs. 188491 | ESTs | | 6.7 |
| 410397 | AF217517 | Hs. 63042 | DKFZp564J157 protein | SS, homeobox, UPF0160, DUF23 | 6.7 |
| 454262 | AW612232 | Hs. 254835 | ESTs | SS, TM, voltage_CLC, CBS | 6.7 |
| 453023 | AW028733 | Hs. 31439 | serine protease inhibitor, Kun | Kunitz_BPTI, SS, TM, ion_tra | 6.6 |
| 419157 | AA234540 | Hs. 23871 | ESTs | pkinase | 6.6 |
| 412464 | T78141 | Hs. 22826 | ESTs, Weakly similar to I55214 | SS, cadherin, crystall | 6.6 |
| 407332 | AI801565 | Hs. 200113 | Homo sapiens cDNA FLJ379 fis | SS, adh_short, Transglutami | 6.6 |
| 456643 | AW751497 | Hs. 98370 | cytochrome P450, subfamily IIS | | 6.6 |
| 411490 | R39474 | | gb: yh95b09 r1 Soares placenta | SS | 6.6 |
| 455885 | BE153524 | | gb: PM0-HT0339-241199-002-C03 H | SS, pkinase | 6.6 |
| 438857 | AI627912 | Hs. 130783 | Forssman synthetase | SS, RA, RasGEF, RasGEFN | 6.6 |
| 420307 | AW502869 | Hs. 66219 | ESTs | SS, TM | 6.6 |
| 453496 | AA442103 | Hs. 33084 | solute carrier family 2 (facil | sugar_tr, SS, TM | 6.6 |
| 419182 | AA234822 | Hs. 66147 | ESTs | ES, TM, ion_trans, ion_trans | 6.6 |
| 406301 | | | Target Exon | TM | 6.6 |
| 433938 | AF161536 | Hs. 284292 | ubiquinol-cytochrome c reducta | TM | 6.6 |
| 448980 | AL137527 | Hs. 289038 | hypothetical protein MGC4126 | | 6.6 |
| 454095 | AW178110 | Hs. 191705 | gb: IL3-HT0061-010999-013-H04 H | SS, TM, homeobox, trypsin, PD | 6.6 |

TABLE 14A-continued

| Pkey | ExAccn | UniGene ID | Unigene Title | Pred Protein Dom | R1 |
|---|---|---|---|---|---|
| 459702 | AI204995 | | gb: an03c03.x1 Stratagene schiz | | 6.6 |
| 422201 | NM_001505 | Hs. 113207 | G protein-coupled receptor 30 | 7tm_1, SS, TM | 6.6 |
| 406779 | AA412048 | Hs. 279574 | CGI-39 protein, cell death-reg | SS, SS | 6.6 |
| 404149 | | | C6002509*: gi|5031885|ref|NP_00 | SS, TM, kringle | 6.6 |
| 418576 | AW968159 | Hs. 302740 | Epithelial calcium channel 2, | SS, TM | 6.6 |
| 421363 | NM_001381 | Hs. 103854 | docking protein 1, 62 kD (downs | PH, IRS, TM, PH, IRS, trypsin, | 6.6 |
| 458919 | AI681567 | Hs. 13349 | KIAA0756 protein | TM | 6.6 |
| 427502 | AI811865 | Hs. 7133 | Homo sapiens, clone IMAGE 3161 | SS, TM, ABC_tran, Glyco_tran | 6.5 |
| 412289 | AW935967 | Hs. 170162 | KIAA1357 protein | SS | 6.5 |
| 447105 | AW377610 | Hs. 11123 | DKFZP564G092 protein | SS, TM | 6.5 |
| 444672 | Z95636 | Hs. 11669 | laminin, alpha 5 | laminin_EGF, laminin_G, EGF | 6.5 |
| 429299 | AI620463 | Hs. 347408 | hypothetical protein MGC13102 | SS, TM, gla | 6.5 |
| 420003 | AA256906 | Hs. 111364 | ESTs, Weakly similar to ubiqui | SS, TM | 6.5 |
| 431849 | AI670823 | Hs. 85573 | hypothetical protein MGC10911 | SS, TM | 6.5 |
| 430396 | D49742 | Hs. 241363 | hyaluronan-binding protein 2 | trypsin, kringle, EGF, SS | 6.5 |
| 437662 | AA765387 | | ESTs | WD40, RCC1, SPRY | 6.5 |
| 436543 | NM_002212 | Hs. 5215 | integrin beta 4 binding protei | eIF6 | 6.5 |
| 405375 | | | CX000741* gi|4885461|ref|NP_00 | SS, TM | 6.5 |
| 430116 | AA465350 | Hs. 119400 | ESTs | SS, TM, adh_short | 6.5 |
| 406109 | | | Target Exon | | 6.5 |
| 414871 | BE549179 | Hs. 29008 | gb: 601078714F1 NIH_MGC_12 Homo | | 6.5 |
| 440656 | AI979248 | Hs. 148221 | ESTs | | 6.5 |
| 438951 | U51336 | Hs. 6453 | inositol 1,3,4-triphosphate 5/ | SS, oxidored_nitro, SS | 6.5 |
| 405376 | | | Target Exon | SS, TM | 6.5 |
| 426925 | NM_001196 | Hs. 315689 | Homo sapiens cDNA FLJ22373 fi | SS | 6.5 |
| 400500 | | | Target Exon | | 6.5 |
| 408294 | BE141732 | | gb: QV0-HT0101-061099-032-e07 H | Ammonium_transp | 6.5 |
| 447904 | AW206303 | | ESTs | | 6.4 |
| 439211 | AI890347 | Hs. 271923 | Homo sapiens cDNA FLJ22785 fi | SS | 6.4 |
| 426828 | NM_000020 | Hs. 172670 | activin A receptor type II-lik | pkinase, Activin_recp, SS, T | 6.4 |
| 446100 | AW967109 | Hs. 13804 | hypothetical protein dJ462O23 | SS, TM | 6.4 |
| 442146 | R52599 | | gb: yg81g01 r1 Soares infant br | TM | 6.4 |
| 425041 | AI377150 | Hs. 150914 | ESTs | SS | 6.4 |
| 457584 | AA147979 | Hs. 285005 | mitochondrial import receptor | Josephin | 6.4 |
| 435449 | AA682379 | Hs. 303460 | EST | | 6.4 |
| 406284 | | | Homo sapiens mRNA full length | | 6.4 |
| 425944 | AK000664 | Hs. 164256 | hypothetical protein FLJ20657 | | 6.4 |
| 453367 | AW732847 | Hs. 70573 | PKCI-1-related HIT protein | SS, TM | 6.4 |
| 419725 | U66048 | Hs. 92683 | Homo sapiens clone 161455 brea | | 6.4 |
| 412452 | AA215731 | | suppression of tumorigenicity | SS | 6.4 |
| 421273 | AJ245416 | Hs. 103106 | U6 snRNA-associated Sm-like pr | Sm, SS, tRNA-synt_1, GST_C, G | 6.4 |
| 432746 | AA564512 | Hs. 24301 | polymerase (RNA) II (DNA direc | SS, TM, EF1BD | 6.4 |
| 429398 | AA452239 | | KIAA0970 protein | | 6.4 |
| 404430 | | | C8000066*: gi|10432395|emb|CAC1 | SS | 6.4 |
| 427339 | AI734109 | Hs. 97984 | SRY (sex determining region Y) | | 6.4 |
| 436389 | AI811706 | | CHMP1 5 protein | | 6.4 |
| 428890 | AA525226 | Hs. 303293 | ESTs, Moderately similar to I5 | | 6.4 |
| 445333 | BE537641 | Hs. 44278 | hypothetical protein FLJ12538 | SS | 6.4 |
| 414756 | AW451101 | Hs. 159489 | ESTs, Moderately similar to JC | hexokinase2, hexokinase | 6.4 |
| 423847 | U16997 | Hs. 133314 | RAR-related orphan receptor C | hormone_rec, zf-C4, SS, TM, h | 6.4 |
| 408493 | BE206854 | Hs. 46039 | phosphoglycerate mutase 2 (mus | PGAM, BRCT, RNA_pol_L | 6.4 |
| 439569 | AW602166 | Hs. 222399 | CEGP1 protein | CUB, EGF, SS | 6.4 |
| 457274 | AW674193 | Hs. 227152 | mannan-binding lectin senne p | SS, TM, SS, TM, Clathrin_lg_c | 6.4 |
| 444550 | BE250716 | Hs. 87614 | ESTs | SS | 6.4 |
| 407198 | H91679 | | gb: yv04a07.s1 Soares fetal liv | BIR | 6.4 |
| 423828 | AL137491 | Hs. 125511 | Homo sapiens mRNA, cDNA DKFZp4 | SS, TM, sushi | 6.4 |
| 422682 | W05238 | Hs. 94316 | ESTs, Weakly similar to T31613 | SS, TM, DEAD, helicase_C, Lam | 6.3 |
| 447887 | AA114050 | Hs. 19949 | caspase 8, apoptosis-related c | ICE_p20, DED, ICE_p10 | 6.3 |
| 400137 | | | Eos Control | | 6.3 |
| 408784 | AW971350 | Hs. 63386 | ESTs | SS | 6.3 |
| 435028 | AW193035 | Hs. 187370 | ESTs | | 6.3 |
| 438113 | AI467908 | Hs. 8882 | ESTs | SS, TM, 7tm_1 | 6.3 |
| 417810 | D28419 | Hs. 82609 | hydroxymethylbilane synthase | Porphobil_deam | 6.3 |
| 436050 | AI057205 | Hs. 14584 | ESTs | | 6.3 |
| 403672 | | | C4001244: gi|539933|pir||A61275 | tubulin, TM | 6.3 |
| 448269 | BE622358 | Hs. 61260 | hypothetical protein FLJ13164 | | 6.3 |
| 430217 | N47863 | Hs. 180450 | ribosomal protein S24 | Ribosomal_S24e | 6.3 |
| 426675 | AW084791 | Hs. 133122 | hypothetical protein FLJ14524 | SS, TM, aminotran_1_2 | 6.3 |
| 423510 | AB000824 | Hs. 129712 | trehalase (brush-border membra | Trehalase | 6.3 |
| 428573 | AA430651 | Hs. 209249 | ESTs | | 6.3 |
| 457052 | BE167242 | Hs. 47099 | hypothetical protein FLJ21212 | SS | 6.3 |
| 445099 | BE163341 | | gb: QV3-HT0458-230200-099-b01 H | | 6.3 |
| 450334 | AF035959 | Hs. 24879 | phosphatidic acid phosphatase | PAP2, SS | 6.3 |
| 416000 | R82342 | Hs. 79856 | ESTs, Weakly similar to S65657 | SS, TM, sugar_tr | 6.3 |
| 427880 | AA436011 | Hs. 98187 | ESTs | | 6.3 |
| 426722 | U53823 | Hs. 171952 | occludin | Occludin, SS, TM, BIR | 6.3 |
| 452072 | BE258857 | Hs. 27744 | RAB3A, member RAS oncogene fam | ras, arf, SS, PDEase | 6.2 |

TABLE 14A-continued

| Pkey | ExAccn | UniGene ID | Unigene Title | Pred Protein Dom | R1 |
|---|---|---|---|---|---|
| 431161 | AA493591 | | gb: nh01a12 s1 NCI_CGAP_Thy1 Ho | SS | 6.2 |
| 413055 | AV655701 | Hs. 75183 | cytochrome P450, subfamily IIE | p450 | 6.2 |
| 431250 | BE264649 | Hs. 251377 | taxol resistance associated ge | | 6.2 |
| 406373 | | | Target Exon | SS, TM, vwa, FG-GAP, integrin | 6.2 |
| 403003 | | | NM_024944*: Homo sapiens hypoth | TM | 6.2 |
| 437834 | AA769294 | | gb: nz36g03 s1 NCI_CGAP_GCB1 Ho | SS | 6.2 |
| 406299 | | | Target Exon | | 6.2 |
| 439327 | AF086141 | Hs. 50760 | ESTs, Highly similar to BimL [ | SS | 6.2 |
| 414246 | BE391090 | Hs. 280278 | EST | | 6.2 |
| 427812 | AA770424 | Hs. 98162 | ESTs | SS | 6.2 |
| 420926 | AA830402 | Hs. 221216 | ESTs | UQ_con | 6.2 |
| 443766 | N91071 | Hs. 109650 | ESTs | | 6.2 |
| 431082 | AA491600 | | gb: ne80a11 s1 NCI_CGAP_Ew1 Hom | | 6.2 |
| 420530 | AI218431 | | coagulation factor VIII-associ | | 6.2 |
| 407360 | X13075 | | gb: Human 2a12 mRNA for kappa-i | | 6.2 |
| 449008 | AW578003 | Hs. 22826 | tropomodulin 3 (ubiquitous) | | 6.2 |
| 409946 | AW162263 | Hs. 312468 | ESTs, Weakly similar to ALUC_H | RasGAP, C2, PH, BTK | 6.2 |
| 413272 | AA127923 | | ESTs | SS | 6.2 |
| 445050 | AW205483 | Hs. 147260 | ESTs | SS, trypsin, kringle, fn2, EG | 6.2 |
| 458130 | AA115811 | Hs. 6838 | ras homolog gene family, membe | ras, arf | 6.2 |
| 449940 | AW291126 | Hs. 187520 | Homo sapiens, clone IMAGE: 3834 | SS, zf-C2H2 | 6.2 |
| 440390 | AW207385 | Hs. 36475 | KIAA0493 protein | | 6.2 |
| 423106 | N52572 | Hs. 13702 | ESTs, Moderately similar to AL | | 6.2 |
| 402501 | | | sperm specific antigen 2 | ig, MHC_I, SS | 6.1 |
| 431470 | AA832417 | Hs. 139650 | ESTs | SS, ig, pkinase, LRR, LRRCT | 6.1 |
| 416597 | H66891 | | gb: yr71c03 r1 Soares fetal liv | | 6.1 |
| 412122 | AW852707 | | G-rich RNA sequence binding fa | SS, WD40 | 6.1 |
| 415056 | AB004662 | Hs. 77867 | adenosine A1 receptor | 7tm_1, SS, TM | 6.1 |
| 400358 | AF181286 | | Homo sapiens mutant dystrophin | | 6.1 |
| 405473 | | | NM_001093*: Homo sapiens acetyl | CPSase_L_chain, biotin_lip | 6.1 |
| 422625 | AW504698 | Hs. 155976 | cullin 4B | SS, SS, Cullin, Cullin | 6.1 |
| 422262 | AL022315 | Hs. 113987 | lectin, galactoside-binding, s | Gal-bind_lectin | 6.1 |
| 401121 | | | C12001638* gi|7291960|gb|AAF47 | | 6.1 |
| 425188 | AK002052 | Hs. 155071 | hypothetical protein FLJ11190 | TM | 6.1 |
| 457216 | AA452554 | Hs. 283697 | ESTs, Weakly similar to A41796 | bZIP_Maf, SS, P5CR, EF1BD | 6.1 |
| 456021 | BE246628 | Hs. 250726 | gb: TCBAP1D5030 Pediatric pre-B | SS, TM, SS | 6.1 |
| 420319 | AW406289 | Hs. 96593 | hypothetical protein | ras, arf | 6.1 |
| 410082 | AA081594 | Hs. 158311 | Musashi (Drosophila) homolog 1 | SS, HECT, phoslip | 6.1 |
| 450593 | AF129085 | Hs. 25197 | STIP1 homology and U-Box conta | TPR, SS, TM, Rhomboid, lactam | 6.1 |
| 437050 | AA766420 | | ESTs | SS | 6.1 |
| 458835 | AI868753 | Hs. 76372 | ESTs | SS | 6.1 |
| 412777 | AI335773 | | ESTs | | 6.1 |
| 454364 | BE263928 | Hs. 323806 | gb: 601191272F1 NIH_MGC_7 Homo | SS, TM | 6.1 |
| 448877 | AI583696 | Hs. 253313 | ESTs | | 6.1 |
| 413045 | X92121 | Hs. 75180 | protein phosphatase 5, calalyt | Metallophos, TPR | 6.1 |
| 408054 | AW816490 | Hs. 8102 | ESTs | | 6.1 |
| 417852 | AJ250562 | Hs. 82749 | transmembrane 4 superfamily me | transmembrane4, SS, TM | 6.1 |
| 410445 | AA199830 | | gb: zq75h01 r1 Stratagene hNT n | | 6.1 |
| 415870 | H15578 | Hs. 21017 | ESTs | | 6.1 |
| 438723 | M34429 | | gb: Human PVT-IGLC fusion prote | | 6.1 |
| 441307 | AW071696 | Hs. 209065 | hypothetical protein FLJ14225 | SS, TM | 6.0 |
| 406575 | | | Target Exon | SS, pkinase, pkinase_C, RFX_ | 6.0 |
| 401488 | | | Target Exon | Glyco_hydro_1 | 6.0 |
| 437650 | AA814338 | Hs. 292297 | ESTs | | 6.0 |
| 439827 | AA846538 | Hs. 187389 | ESTs | pkinase, DAG_PE-bind, PH | 6.0 |
| 456373 | BE247706 | Hs. 89751 | membrane-spanning 4-domains, s | SS, TM | 6.0 |
| 454513 | BE159271 | Hs. 109731 | gb: MR0-HT0407-180100-004-h05 H | | 6.0 |
| 414944 | C15044 | | gb: C15044 Clontech human aorta | SS, TM | 6.0 |
| 451277 | AK001123 | Hs. 26176 | hypothetical protein FLJ10261 | TM, SS, TM, death, DED | 6.0 |
| 421190 | U95031 | Hs. 102482 | mucin 5, subtype B, tracheobro | Cys_knot, vwc | 6.0 |
| 401215 | | | C12000457* gi|7512178|pir||T30 | trypsin, SS, TM | 6.0 |
| 408117 | AL138255 | | ESTs, Weakly similar to I38022 | SS, zf-C3HC4, BIR | 6.0 |
| 426357 | AW753757 | Hs. 12396 | gb: RC3-CT0283-271099-021-a08 C | | 6.0 |
| 418630 | AI351311 | Hs. 251946 | poly(A)-binding protein, cytop | SS, pkinase | 6.0 |
| 400389 | AL135841 | | olfactory receptor, family 2, | 7tm_1, SS, TM, CSD | 6.0 |
| 447128 | AI271898 | | cyclin K | | 6.0 |
| 431297 | AA651771 | Hs. 3076 | ESTs | | 6.0 |
| 431857 | W19144 | Hs. 271742 | ADP-ribosyltransferase (NAD, p | PARP, PARP_reg, SS, TM, Pepti | 6.0 |
| 430023 | AA158243 | Hs. 227729 | FK506-binding protein 2 (13 kD) | SS, FKBP, SS, PDGF, C2, PI-PLC | 6.0 |
| 453101 | AW952776 | Hs. 94943 | ESTs | TM | 6.0 |
| 407383 | AA532576 | | ESTs, Moderately similar to AL | SS, Patatin, ank | 6.0 |
| 430132 | AA204686 | Hs. 234149 | hypothetical protein FLJ20647 | SS, SS, TM, ig | 6.0 |
| 459111 | AU077013 | Hs. 28757 | transmembrane 9 superfamily me | EMP70 | 6.0 |
| 405770 | | | NM_002362 Homo sapiens melanom | MAGE | 6.0 |
| 415611 | T26376 | | gb: AB123C11R Infant brain, LLN | SS, TM, rrm, sushi | 6.0 |
| 453413 | AJ003294 | | gb: AJ003294 Selected chromosom | SS, Folate_carrier | 6.0 |
| 424415 | NM_001975 | Hs. 146580 | enolase 2, (gamma, neuronal) | enolase, SS, Atrophin-1, Atr | 5.9 |

TABLE 14A-continued

| Pkey | ExAccn | UniGene ID | Unigene Title | Pred Protein Dom | R1 |
|---|---|---|---|---|---|
| 426048 | AI768853 | Hs. 134478 | ESTs | TM | 5.9 |
| 435750 | AB029012 | Hs. 4990 | KIAA1089 protein | SS, TM | 5.9 |
| 439469 | W69836 | | gb: zd48a02 r1 Soares_fetal_hea | SS, pkinase, C2, pkinase_C, D | 5.9 |
| 445664 | AW968638 | Hs. 237691 | ESTs, Weakly similar to KIAA06 | | 5.9 |
| 418830 | BE513731 | Hs. 88959 | hypothetical protein MGC4816 | TM, CDP-OH_P_transf | 5.9 |
| 452113 | AI859393 | | gb: wm11a02.x1 NCI_CGAP_Ut4 Hom | actin | 5.9 |
| 449101 | AA205847 | Hs. 23016 | G protein-coupled receptor | 7tm_1, SS, TM | 5.9 |
| 437640 | AA764893 | Hs. 272155 | ESTs, Weakly similar to I38022 | | 5.9 |
| 400748 | | | NM_022122. Homo sapiens matrix | SS, Peptidase_M10, hemopexi | 5.9 |
| 442370 | AI143593 | Hs. 129419 | ESTs | | 5.9 |
| 442419 | AI749893 | Hs. 270532 | ESTs, Weakly similar to I38022 | Adaptin_N, Alpha_adaptinC2 | 5.9 |
| 439986 | AW750272 | Hs. 128608 | ESTs | SS, TM, ISK_Channel | 5.9 |
| 407553 | Z11168 | | gb: H. sapiens 5HT1A receptor re | SS, TM | 5.9 |
| 431424 | AI222969 | | ESTs | SS | 5.9 |
| 442297 | NM_006202 | Hs. 89901 | phosphodiesterase 4A, cAMP-spe | PDEase | 5.9 |
| 457845 | H93040 | Hs. 297729 | ESTs | SS, TM, WD40 | 5.9 |
| 446912 | AI347650 | Hs. 128521 | ESTs, Moderately similar to AL | SS | 5.9 |
| 451381 | BE241831 | Hs. 172330 | hypothetical protein MGC2705 | SS, Ribosomal_L28e | 5.9 |
| 416024 | AW886484 | Hs. 343522 | ATPase, Ca transporting, plasm | E1-E2_ATPase, Hydrolase, Ca | 5.9 |
| 446329 | NM_013272 | Hs. 14805 | solute carrier family 21 (orga | kazal, OATP_N, OATP_C | 5.9 |
| 431321 | AW136372 | Hs. 1852 | acid phosphatase, prostate | SS, TM, acid_phosphat | 5.9 |
| 420039 | NM_004605 | Hs. 94581 | sulfotransferase family, cytos | Sulfotransfer, SS, DAGKc | 5.9 |
| 428223 | AA424313 | Hs. 98402 | ESTs | HECT | 5.9 |
| 433333 | AI016521 | Hs. 71816 | v-akt murine thymoma viral onc | homeobox, pkinase, PH, pkina | 5.9 |
| 450251 | BE080483 | | gb: QV1-BT0630-280200-086-a05 B | SS | 5.9 |
| 408511 | AW206404 | Hs. 27268 | ESTs | | 5.9 |
| 414348 | AF041430 | Hs. 75922 | brain protein I3 | SS, SH3 | 5.9 |
| 456950 | AF111170 | Hs. 306165 | Homo sapiens 14q32 Jagged2 gen | SS, TM, DSL | 5.9 |
| 412173 | T71071 | | gb: yc50b05.r1 Stratagene liver | CPSase_L_chain | 5.8 |
| 404001 | | | Target Exon | | 5.8 |
| 445263 | H57646 | Hs. 42586 | KIAA1560 protein | SS | 5.8 |
| 441583 | AI791499 | Hs. 205742 | ESTs, Weakly similar to ALUA_H | | 5.8 |
| 430168 | AW968343 | | DKFZP434I1735 protein | SS, TM, efhand, efhand | 5.8 |
| 454682 | AW816029 | | gb: MR3-ST0220-151299-027-b10 S | filament | 5.8 |
| 453829 | AL138200 | | gb: DKFZp547N052_r1 547 (synony | SS, TM, ATP-synt_C, Galactos | 5.8 |
| 437372 | AA323968 | Hs. 283631 | hypothetical protein DKFZp547G | SS | 5.8 |
| 421726 | AK001237 | Hs. 319088 | hypothetical protein FLJ10375 | TM | 5.8 |
| 451045 | AA215672 | | gb: zr96e09 s1 NCI_CGAP_GCB1 Ho | SS, Peptidase_C1, zf-C2H2 | 5.8 |
| 439616 | BE018635 | Hs. 58582 | Homo sapiens cDNA FLJ12789 fis | SS, TM | 5.8 |
| 455679 | BE066529 | | gb: RC3-BT0333-300300-017-a12 B | UBX | 5.8 |
| 457125 | AW444451 | Hs. 134812 | ESTs | SS | 5.8 |
| 430600 | AW950967 | Hs. 274348 | HLA-B associated transcript-3 | ubiquitin, SS, TM, G-patch, a | 5.8 |
| 421707 | NM_014921 | Hs. 107054 | lectomedin-2 | Latrophilin, OLF, 7tm_2, Gal | 5.8 |
| 436127 | W94824 | Hs. 11565 | RIKEN cDNA 2010100O12 gene | Corona_7, SS, TM | 5.8 |
| 414347 | BE275835 | | gb: 601121639F1 NIH_MGC_20 Homo | SS | 5.8 |
| 439910 | H66765 | Hs. 339397 | ESTs | SS | 5.8 |
| 410382 | AW664971 | Hs. 259546 | ESTs | LIM | 5.8 |
| 426391 | AW161050 | Hs. 169611 | second mitochondria-derived ac | SS | 5.8 |
| 423358 | AI815474 | Hs. 343866 | gb: au47f10.y1 Schneider fetal | SS | 5.8 |
| 440146 | AW014231 | Hs. 90790 | Homo sapiens cDNA FLJ22930 fi | Peptidase_M1 | 5.8 |
| 402189 | | | ENSP00000247423*: D-siglec prec | | 5.8 |
| 439949 | AW979197 | Hs. 292073 | ESTs, Weakly similar to ALU7_H | | 5.8 |
| 457978 | AA776638 | | gb: ae78g04 s1 Stratagene schiz | SS, PH, IQ, RasGEF, RasGEFN, R | 5.8 |
| 436685 | W28661 | Hs. 5288 | Homo sapiens mRNA, cDNA DKFZp4 | SS, TM, pkinase, Activin_rec | 5.8 |
| 411602 | L01406 | Hs. 767 | growth hormone releasing hormo | 7tm_2, HRM | 5.8 |
| 433357 | T05639 | | gb: EST03528 Fetal brain, Strat | SS | 5.8 |
| 404311 | | | Target Exon | TM | 5.8 |
| 428092 | AW879141 | | ESTs | SS, TM | 5.8 |
| 452620 | AA436504 | Hs. 119286 | ESTs | SS | 5.8 |
| 401938 | | | Target Exon | SS, PHD, proteasome | 5.7 |
| 407202 | N58172 | Hs. 109370 | ESTs | SS, F5_F8_type_C, pkinase, E | 5.7 |
| 458882 | R34993 | Hs. 226666 | ESTs, Moderately similar to I5 | SS, CRAL_TRIO, PKI | 5.7 |
| 452357 | AI638176 | Hs. 283865 | ESTs | SS, TM, SS, TM | 5.7 |
| 452625 | AA724771 | Hs. 61425 | ESTs | | 5.7 |
| 430281 | AI878842 | Hs. 237924 | CGI-69 protein | mito_carr, SS, TM | 5.7 |
| 430490 | AW902951 | Hs. 301723 | Homo sapiens cDNA FLJ12974 fis | TM | 5.7 |
| 450122 | BE313765 | Hs. 343443 | ESTs, Weakly similar to I38022 | SS, TM, Y_phosphatase, LON, A | 5.7 |
| 450801 | AI739013 | Hs. 203348 | ESTs | SS, TM, Hint, HH_signal | 5.7 |
| 413413 | D82520 | Hs. 132390 | zinc finger protein 36 (KOX 18 | SS, rrm, DUF185 | 5.7 |
| 445631 | AK001822 | | Homo sapiens cDNA FLJ10960 fis | | 5.7 |
| 419390 | AI701162 | Hs. 90207 | hypothetical protein MGC11138 | SS, TM, PMP22_Claudin, PMP22 | 5.7 |
| 423139 | AW402725 | Hs. 288560 | hypothetical protein FLJ21106 | | 5.7 |
| 426221 | AB007881 | | KIAA0421 protein | PI3_PI4_kinase, FATC, SS, TM | 5.7 |
| 443785 | AW449952 | Hs. 190125 | basic-helix-loop-helix-PAS pro | | 5.7 |
| 417900 | BE250127 | Hs. 82906 | CDC20 (cell division cycle 20, | WD40, SS, TM, fn3, EGF, fn3, ig | 5.7 |
| 446596 | AW204515 | Hs. 156113 | ESTs, Weakly similar to G01025 | | 5.7 |
| 432353 | NM_016558 | Hs. 274411 | SCAN domain-containing 1 | SCAN | 5.7 |

TABLE 14A-continued

| Pkey | ExAccn | UniGene ID | Unigene Title | Pred Protein Dom | R1 |
|---|---|---|---|---|---|
| 427625 | AF008216 | Hs. 285013 | putative human HLA class II as | | 5.7 |
| 421543 | AK000519 | Hs. 105606 | hypothetical protein FLJ20512 | TM | 5.7 |
| 418087 | AA961613 | Hs. 127838 | ESTs | | 5.7 |
| 432751 | AF152099 | Hs. 278911 | interleukin 17C | SS | 5.7 |
| 433943 | AA992805 | Hs. 44865 | lymphoid enhancer-binding fact | | 5.7 |
| 414274 | AW300961 | Hs. 334684 | *Homo sapiens*, clone IMAGE 4127 | SS, Vps26, Acyl-CoA_dh | 5.7 |
| 431328 | AA502999 | Hs. 291591 | ESTs | | 5.7 |
| 451481 | AA300228 | Hs. 295866 | hypothetical protein DKFZp434N | | 5.7 |
| 430344 | AA476827 | Hs. 171012 | hypothetical protein FLJ22349 | HLH | 5.6 |
| 419516 | H82550 | | ATP-binding cassette, sub-fami | SS, TM, ABC_tran, ABC_membra | 5.6 |
| 413564 | BE260120 | | gb: 601146990F1 NIH_MGC_19 Homo | | 5.6 |
| 415958 | H10942 | | gb: ym06c11 r1 Soares infant br | SS, TM | 5.6 |
| 401402 | | | Target Exon | | 5.6 |
| 456145 | BE299427 | Hs. 21446 | KIAA1716 protein | SS, DIX, PDZ, DEP, Dishevelle | 5.6 |
| 431536 | AL133066 | Hs. 341906 | ESTs | TM, SAM_decarbox, SS, pkinas | 5.6 |
| 456266 | L29073 | Hs. 198726 | cold shock domain protein A | CSD, homeobox, SS, TM, 7tm_2, | 5.6 |
| 435800 | AI248285 | Hs. 118348 | ESTs | TM, ECH, chromo | 5.6 |
| 449285 | AI912702 | Hs. 139135 | ESTs | | 5.6 |
| 418256 | AW845318 | Hs. 12271 | f-box and leucine-rich repeat | SS, SS, TM, HSF_DNA-bind | 5.6 |
| 417442 | AA199940 | Hs. 124039 | ESTs | | 5.6 |
| 405931 | | | Target Exon | | 5.6 |
| 455286 | BE144384 | | gb: MR0-HT0166-191199-004-c11 H | SS | 5.6 |
| 446931 | AI348856 | Hs. 21627 | gb: tb05a05 x2 NCI_CGAP_Lu26 Ho | | 5.6 |
| 446548 | AI769392 | Hs. 200215 | ESTs | SS, TM, Ribosomal_S25, sugar | 5.6 |
| 401984 | | | C17000146* gi|2143629|pir||A57 | pkinase, SS, TM, P2X_recepto | 5.6 |
| 404066 | | | Target Exon | SS, tRNA-synt_2b, HGTP_anti | 5.6 |
| 418363 | AA218628 | Hs. 202977 | ESTs | | 5.6 |
| 458198 | AI286100 | | ESTs | | 5.6 |
| 432278 | AL137506 | Hs. 274256 | hypothetical protein FLJ23563 | SS, TM, GNS1_SUR4, SS, TM, Rho | 5.6 |
| 432328 | AI572739 | Hs. 195471 | 6-phosphofructo-2-kinase/fruct | PGAM, 6PF2K | 5.6 |
| 421871 | AK001416 | Hs. 306122 | glycoprotein, synaptic 2 | TM, Steroid_dh, SS | 5.6 |
| 415514 | F11301 | Hs. 138329 | ESTs | SS, TM | 5.6 |
| 426208 | AI370379 | Hs. 132216 | ESTs | SS, TM | 5.6 |
| 429367 | AB007867 | Hs. 278311 | plexin B1 | Sema, PSI, TIG, SS, TM, TIG, Se | 5.6 |
| 405939 | | | Target Exon | | 5.6 |
| 457331 | AV647405 | Hs. 18443 | aldehyde dehydrogenase 8 famil | GTP_EFTU | 5.6 |
| 438705 | AI049624 | Hs. 283390 | ESTs, Weakly similar to 210926 | SS, E2F_TDP, E2F_TDP | 5.6 |
| 428624 | AI125222 | Hs. 98712 | hypothetical protein DKFZp434H | SS, TM, ras, MSP_domain | 5.6 |
| 419389 | AI074951 | Hs. 319095 | ESTs | SS, DPPIV_N_term | 5.6 |
| 447595 | AW379130 | Hs. 18953 | phosphodiesterase 9A | PDEase | 5.6 |
| 408015 | AW136771 | Hs. 244349 | epidermal differentiation comp | | 5.6 |
| 413041 | BE061580 | Hs. 61622 | gb: MR0-BT0249-091299-201-c07 B | SS | 5.5 |
| 452849 | AF044924 | Hs. 30792 | hook2 protein | bZIP, SS, AhpC-TSA | 5.5 |
| 434357 | AW732284 | Hs. 3828 | mevalonate (diphospho) decarbo | GHMP_kinases, SS, TM | 5.5 |
| 455274 | BE151622 | | gb: PM0-HT0302-271099-001-a08 H | SS, TM, RNA_pol_L | 5.5 |
| 453904 | AW003821 | | ESTs | | 5.5 |
| 424624 | AB032947 | Hs. 151301 | Ca2+dependent activator protei | Fork_head | 5.5 |
| 426576 | AA381720 | | gb: EST94853 Activated T-cells | vwa, integrin_A, FG-GAP | 5.5 |
| 440682 | AW362152 | Hs. 27181 | nuclear receptor binding facto | | 5.5 |
| 419125 | AA642452 | Hs. 130881 | B-cell CLL/lymphoma 11A (zinc | SS | 5.5 |
| 450207 | T87615 | Hs. 14716 | ESTs | | 5.5 |
| 405211 | | | C7000900 gi|4508027|ref|NP_003 | SS | 5.5 |
| 413937 | H65775 | Hs. 207915 | ESTs | | 5.5 |
| 426793 | X89887 | Hs. 172350 | HIR (histone cell cycle regula | WD40, Clathrin, Clathrin_pr | 5.5 |
| 412091 | R06185 | | gb: ye94d03 r1 Soares fetal liv | SS, TM, IBR, IBR | 5.5 |
| 446536 | W74413 | Hs. 15251 | hypothetical protein | SS | 5.5 |
| 451117 | AA015752 | Hs. 205173 | ESTs | | 5.5 |
| 409547 | AW409885 | Hs. 335877 | *Homo sapiens*, clone MGC 4558, | TM | 5.5 |
| 412673 | AL042957 | Hs. 31845 | ESTs | | 5.5 |
| 426440 | BE382756 | Hs. 169902 | solute carrrier family 2 (facil | sugar_tr, SS, TM, sugar_tr | 5.5 |
| 449225 | R39108 | Hs. 6777 | ESTs | SS, TM, Na_sulph_symp | 5.5 |
| 403938 | | | Target Exon | Ephrin | 5.5 |
| 441197 | BE244638 | Hs. 166 | sterol regulatory element bind | HLH | 5.5 |
| 455604 | BE011183 | | gb: PM3-BN0218-100500-003-d09 B | | 5.5 |
| 457468 | AW971345 | Hs. 292715 | ESTs | | 5.5 |
| 447677 | AI419235 | Hs. 344456 | gb: tf21d02 x1 NCI_CGAP_Brn23 H | SS, zf-C2H2, SCAN, SCAN, zf-C | 5.5 |
| 415473 | R39986 | Hs. 12778 | ESTs | TM, ion_trans | 5.5 |
| 408422 | AW977031 | Hs. 143554 | ESTs, Highly similar to B45036 | | 5.5 |
| 442780 | AI017521 | | ESTs | SS, TM, 7tm_1 | 5.5 |
| 451558 | NM_001089 | Hs. 26630 | ATP-binding cassette, sub-fami | ABC_tran, SRP54, SS, TM, ECH | 5.5 |
| 439422 | AW452791 | Hs. 249625 | ESTs | SS, TM | 5.5 |
| 423479 | NM_014326 | Hs. 129208 | death-associated protein kinas | pkinase | 5.5 |
| 459558 | AI539821 | Hs. 298799 | ESTs, Weakly similar to 210926 | SS | 5.5 |
| 441187 | AW195237 | Hs. 7734 | hypothetical protein FLJ22174 | SS, TM, tubulin | 5.5 |
| 420894 | AA744597 | Hs. 88854 | ESTs | SS, ank | 5.5 |
| 404710 | | | C9001584: gi|7499208|pir||T2099 | | 5.5 |
| 447827 | U73727 | Hs. 19718 | protein tyrosine phosphatase, | Y_phosphatase, fn3, ig, MAM, | 5.5 |

TABLE 14A-continued

| Pkey | ExAccn | UniGene ID | Unigene Title | Pred Protein Dom | R1 |
|---|---|---|---|---|---|
| 448387 | AI874402 | Hs. 292590 | ESTs | | 5.5 |
| 419541 | AW749617 | Hs. 280776 | tankyrase, TRF1-interacting an | | 5.5 |
| 449686 | AW072813 | Hs. 270868 | ESTs, Moderately similar to AL | | 5.5 |
| 426315 | AA854219 | Hs. 348137 | *Homo sapiens*, clone IMAGE 3542 | SS, crystall | 5.5 |
| 451312 | AI769831 | Hs. 337054 | ESTs | SS | 5.5 |
| 432538 | BE258332 | Hs. 278362 | male-enhanced antigen | SS, TM, AAA, Ribosomal_L2 | 5.5 |
| 446790 | AW452105 | | ESTs | SS, zf-C2H2 | 5.5 |
| 448682 | T09471 | Hs. 250820 | hypothetical protein FLJ14827 | | 5.5 |
| 425234 | AW152225 | Hs. 165909 | ESTs, Weakly similar to I38022 | SS | 5.5 |
| 411219 | AW832917 | | gb: QV2-TT0003-161199-013-h06 T | | 5.5 |
| 439742 | AI827721 | Hs. 284298 | *Homo sapiens* mRNA full length | SS | 5.5 |
| 432004 | BE018302 | Hs. 2894 | placental growth factor, vascu | PDGF, SS | 5.5 |
| 402916 | | | ENSP00000202587*: Bicarbonate t | HCO3_cotransp, SS | 5.5 |
| 405346 | | | Rag C protein | RCC1 | 5.5 |
| 415976 | R43144 | Hs. 21919 | ESTs | TM | 5.4 |
| 435064 | T70740 | Hs. 31433 | ESTs | SS, MDM2 | 5.4 |
| 440024 | AA969333 | Hs. 160098 | ESTs | | 5.4 |
| 431525 | AA506656 | Hs. 6185 | KIAA1557 protein | | 5.4 |
| 458644 | AW270149 | | ESTs, Moderately similar to GG | | 5.4 |
| 410895 | AW809679 | | gb: MR4-ST0124-261099-015-f05 S | | 5.4 |
| 441350 | AB020690 | Hs. 7782 | paraneoplastic antigen MA2 | SS | 5.4 |
| 413034 | BE392896 | Hs. 129126 | *Homo sapiens*, clone MGC. 10992, | | 5.4 |
| 444664 | N26362 | Hs. 11615 | map kinase phosphatase-like pr | DSPc, Rhodanese, SS, TM | 5.4 |
| 443887 | NM_004729 | Hs. 9933 | Ac-like transposable element | zf-BED | 5.4 |
| 445871 | AI702901 | Hs. 145582 | ESTs, Weakly similar to FOR4 M | SS, TM, efhand, efhand | 5.4 |
| 411992 | AW816214 | Hs. 143055 | ESTs | SS, TM | 5.4 |
| 458341 | AW373583 | Hs. 221994 | gb: QV4-BT0534-281299-053-e08 B | | 5.4 |
| 451677 | AA059222 | Hs. 33538 | ESTs, Weakly similar to oxygen | | 5.4 |
| 432656 | NM_000246 | Hs. 3076 | MHC class II transactivator | LRR | 5.4 |
| 417739 | Z43995 | | gb: HSC1QB121 normalized infant | SS, ArfGap, vwa, TSPN, fn3, Co | 5.4 |
| 424618 | L29472 | Hs. 1802 | major histocompatibility compl | TM, ig, MHC_II_beta, SS, TM, A | 5.4 |
| 446847 | T51454 | Hs. 82845 | *Homo sapiens* cDNA FLJ21930 fi | SS, TM, BNR, fn3, ldl_recept_ | 5.4 |
| 436094 | AI798701 | | ESTs | | 5.4 |
| 433168 | AI085436 | | gb: ow84g06 s1 Soares_fetal_liv | SS, TM, PID | 5.4 |
| 417359 | T99264 | Hs. 191117 | ESTs | | 5.4 |
| 436014 | AF281134 | Hs. 283741 | exosome component Rrp46 | RNase_PH, RNase_PH_C, SS, TG | 5.4 |
| 435154 | AA668764 | Hs. 301637 | ESTs | SS, TM | 5.4 |
| 431630 | NM_002204 | Hs. 265829 | integrin, alpha 3 (antigen CD4 | integrin_A, FG-GAP, Rhabd_g | 5.4 |
| 444064 | W85970 | Hs. 16292 | ESTs | SS, TM, Dihydroorotase | 5.4 |
| 415970 | H23333 | Hs. 29002 | KIAA1706 protein | | 5.4 |
| 445303 | AW362198 | Hs. 12503 | interleukin 15 receptor, alpha | SS, sushi, SS | 5.4 |
| 421542 | AA411607 | Hs. 118964 | ESTs, Weakly similar to KIAA11 | SS, SS | 5.4 |
| 459704 | AA719572 | Hs. 274441 | *Homo sapiens* mRNA, cDNA DKFZp4 | | 5.4 |
| 402285 | | | sclerostin | SS, TM | 5.4 |
| 431543 | AW969619 | Hs. 259768 | adenylate cyclase 1 (brain) | TM | 5.4 |
| 431534 | AL137531 | Hs. 258890 | *Homo sapiens* mRNA, cDNA DKFZp4 | SS, TM, ras | 5.4 |
| 417516 | AA203473 | Hs. 81529 | ESTs | TM | 5.4 |
| 423233 | BE048021 | Hs. 11067 | ESTs, Highly similar to T46395 | | 5.4 |
| 420733 | AW291446 | Hs. 88651 | ESTs | SS | 5.4 |
| 404807 | | | Target Exon | UPF0027 | 5.4 |
| 436483 | AJ272063 | Hs. 283010 | vanilloid receptor subtype 1 | SS, TM, ank, ion_trans, SS, TM | 5.4 |
| 425316 | AA354977 | Hs. 99010 | ESTs, Moderately similar to T1 | SS, pkinase, ig | 5.4 |
| 425565 | AA359485 | Hs. 173084 | gb: EST68511 Fetal lung II Homo | | 5.4 |
| 413341 | H78472 | Hs. 191325 | ESTs, Weakly similar to T18967 | | 5.4 |
| 401203 | | | Target Exon | filament | 5.4 |
| 422452 | AL110255 | Hs. 116808 | *Homo sapiens* mRNA, cDNA DKFZp5 | SS, asp, PGAM | 5.4 |
| 436718 | AW015227 | Hs. 289053 | hypothetical protein FLJ14733 | SS, TM | 5.4 |
| 428501 | AL041162 | Hs. 98587 | ESTs | TM | 5.4 |
| 439695 | W28548 | Hs. 285050 | ESTs | TM, ion_trans, K_tetra, Kv2c | 5.3 |
| 417514 | AA203445 | Hs. 325819 | ESTs | | 5.3 |
| 441358 | AW173212 | | ESTs | | 5.3 |
| 401722 | | | Target Exon | TM, PLAT, SS | 5.3 |
| 408905 | AV655783 | Hs. 661 | Target CAT | | 5.3 |
| 454453 | AW752781 | | hypothetical protein FLJ12614 | | 5.3 |
| 410312 | AW850953 | Hs. 75350 | gb: IL3-CT0220-150200-068-A11 C | Vinculin | 5.3 |
| 437926 | BE383605 | Hs. 300816 | small GTP-binding protein | SS, TM, TPR | 5.3 |
| 458682 | AV659151 | Hs. 282961 | ESTs | | 5.3 |
| 411605 | AW006831 | | ESTs | TM, synaptobrevin | 5.3 |
| 409164 | AA706639 | | gb: ag90e09.r1 Stratagene hNT n | SS, TM, Hint, HH_signal, tubu | 5.3 |
| 438868 | AW246243 | Hs. 334800 | hypothetical protein FLJ20974 | | 5.3 |
| 439034 | AF075083 | | gb: *Homo sapiens* full length in | filament, filament | 5.3 |
| 411426 | BE141714 | | gb: QV0-HT0101-061099-032-c04 H | SS | 5.3 |
| 428186 | AW504300 | Hs. 295605 | mannosidase, alpha, class 2A, | Glyco_hydro_38, SS, TM, Pept | 5.3 |
| 438470 | AW936329 | Hs. 227823 | pM5 protein | SS, TM | 5.3 |
| 427789 | AA412428 | Hs. 48642 | hypothetical protein FLJ23093 | | 5.3 |
| 430230 | BE257724 | Hs. 236361 | seb4D | rrm, SS, 2-Hacid_DH, WD40 | 5.3 |
| 434314 | BE392921 | Hs. 3797 | RAB26, member RAS oncogene fam | ras, arf, SS | 5.3 |

TABLE 14A-continued

| Pkey | ExAccn | UniGene ID | Unigene Title | Pred Protein Dom | R1 |
|---|---|---|---|---|---|
| 428539 | AW410063 | Hs. 184877 | solute carrier family 25 (mito | mito_carr, SS, TM, profilin, | 5.3 |
| 414927 | T83587 | Hs. 186476 | ESTs | SS, Sulfatase | 5.3 |
| 404596 | | | Target Exon | SS | 5.3 |
| 454151 | AA047169 | Hs. 154088 | hypothetical protein FLJ22756 | SS, TM, Glycos_transf_4 | 5.3 |
| 431627 | AW609720 | | HSPC042 protein | | 5.3 |
| 422379 | AA932860 | Hs. 133864 | ESTs | | 5.3 |
| 426765 | AA743603 | Hs. 172108 | nucleoporin 88 kD | MAM33 | 5.3 |
| 433325 | AW206986 | Hs. 143905 | ESTs | SS | 5.3 |
| 403128 | | | KIAA1033 protein | SS, TM, tubulin, EGF, F5_F8_t | 5.3 |
| 447730 | AI421251 | Hs. 114085 | Homo sapiens mRNA for KIAA1755 | SS, Transglutamin_C, Transg | 5.3 |
| 405085 | | | Target Exon | SS, SS, SNF2_N, helicase_C | 5.3 |
| 438080 | AA777381 | Hs. 291530 | ESTs, Weakly similar to ALUC_H | | 5.3 |
| 439091 | AA830144 | Hs. 135613 | ESTs, Moderately similar to I3 | KH-domain | 5.3 |
| 427326 | AI287878 | | gb: qv23f06 x1 NCI_CGAP_Lym6 Ho | SS, TM, 7tm_1, SS, TM | 5.3 |
| 427859 | AA416856 | Hs. 98170 | ESTs | SS, TM, DUF60, trypsin, CUB, u | 5.3 |
| 421779 | AI879159 | Hs. 108219 | wingless-type MMTV integration | SS, wnt, SS | 5.3 |
| 408270 | AW177805 | | gb: IL3-HT0059-180899-007-B06 H | | 5.3 |
| 418437 | AA771738 | Hs. 348000 | ESTs, Moderately similar to AL | | 5.3 |
| 409879 | BE083422 | Hs. 56851 | hypothetical protein MGC2668 | SS, TM | 5.3 |
| 428304 | AI743177 | | ESTs | SS, TM | 5.3 |
| 418678 | NM_001327 | Hs. 167379 | cancer/testis antigen (NY-ESO- | SS, TM, zf-C2H2 | 5.3 |
| 436540 | BE397032 | Hs. 14468 | hypothetical protein MGC14226 | SS, TM | 5.2 |
| 437161 | AA054477 | Hs. 25391 | ESTs | SS, TM | 5.2 |
| 400171 | | | ENSP00000211797: Helicase SKI2W | SS, proteasome | 5.2 |
| 431461 | BE299671 | Hs. 256310 | likely ortholog of mouse ZFP28 | | 5.2 |
| 402197 | | | Target Exon | SS, TM, ATP1G1_PLM_MAT8, ig, | 5.2 |
| 449514 | AW970440 | Hs. 23642 | protein predicted by clone 236 | SS, PX, arf, lipocalin, PHD, z | 5.2 |
| 442472 | AW806859 | | gb: MR0-ST0020-081199-004-c03 S | SS, TM, Inos-1-P_synth, Occl | 5.2 |
| 409679 | BE250521 | | ras homolog gene family, membe | SS, homeobox, CUT | 5.2 |
| 439150 | AF086006 | | gb: Homo sapiens full length in | SS | 5.2 |
| 412934 | BE011437 | | gb: CM4-BN0220-080500-170-f03 B | | 5.2 |
| 435186 | AL119470 | | ESTs | SS | 5.2 |
| 400668 | | | Target Exon | CARD, ICE_p20, SS, ICE_p20, I | 5.2 |
| 409125 | R17268 | Hs. 343567 | axonal transport of synaptic v | SS, kinesin, PH, FHA, kinesin | 5.2 |
| 445904 | AW449920 | Hs. 248855 | ESTs | SS, homeobox | 5.2 |
| 414567 | BE281057 | Hs. 184519 | hypothetical protein FLJ12949 | SS, TM, ank, Adap_comp_sub | 5.2 |
| 414551 | AI815639 | Hs. 76394 | enoyl Conezyme A hydratase, sh | ECH, Peptidase_U7, SS, TM | 5.2 |
| 432872 | AI908984 | Hs. 279623 | selenoprotein X, 1 | DUF25, SS, Ribosomal_L3, PDZ | 5.2 |
| 419492 | AA243547 | Hs. 19447 | PDZ-LIM protein mystique | LIM, SS, SH3, Sorb, Metalloph | 5.2 |
| 407478 | L77559 | | gb: Homo sapiens DGS-B partial | | 5.2 |
| 457892 | AA744389 | | gb: ny51e10 s1 NCI_CGAP_Pr18 Ho | | 5.2 |
| 457228 | U15177 | Hs. 206984 | Human cosmid CRI-JC2015 at D10 | 6PF2K, PGAM | 5.2 |
| 437536 | X91221 | Hs. 144465 | ESTs | SS, TM, Na_Ca_Ex | 5.2 |
| 420285 | AA258124 | Hs. 293878 | ESTs, Moderately similar to ZN | | 5.2 |
| 431275 | T56571 | Hs. 10041 | ESTs | SS, HLH | 5.2 |
| 428021 | AI022287 | Hs. 111991 | ESTs, Weakly similar to T33900 | SS | 5.2 |
| 422400 | AA974434 | Hs. 128353 | ESTs | | 5.2 |
| 446442 | BE221533 | Hs. 257858 | ESTs | | 5.2 |
| 415585 | R59946 | Hs. 184852 | KIAA1553 protein | SS | 5.2 |
| 438429 | D16918 | Hs. 12547 | Homo sapiens cDNA FLJ233888 fi | TM | 5.2 |
| 401677 | | | BAI1-associated protein 3 | SS, TM, zf-C2H2, kinesin, Vau | 5.2 |
| 405637 | | | Target Exon | | 5.2 |
| 450437 | X13956 | Hs. 24998 | hypothetical protein MGC10471 | SS | 5.2 |
| 408215 | BE614290 | | syntaxin 10 | SS, SS, TM, HLH, TRM, zf-CCCH | 5.2 |
| 452666 | AW194601 | Hs. 13219 | ESTs | PI-PLC-X, PI-PLC-Y, C2, PH | 5.2 |
| 401553 | | | Target Exon | | 5.2 |
| 447541 | AK000288 | Hs. 18800 | hypothetical protein FLJ20281 | zf-CCHC | 5.2 |
| 453434 | AJ271378 | Hs. 333243 | ESTs | | 5.2 |
| 450351 | BE547267 | Hs. 59791 | hypothetical protein MGC13183 | SS, TM | 5.2 |
| 411456 | AW847588 | | gb: IL3-CT0213-161299-038-G09 C | SS, TM | 5.2 |
| 445634 | AI624849 | Hs. 344612 | ESTs, Weakly similar to NEL1_H | vwd | 5.2 |
| 453740 | AL120295 | Hs. 311809 | ESTs, Moderately similar to PC | | 5.2 |
| 426318 | AA375125 | Hs. 147112 | Homo sapiens cDNA FLJ22322 fi | SS, TM, EPH_lbd, pkinase, fn3 | 5.1 |
| 416470 | N90464 | Hs. 303023 | beta tubulin 1, class VI | SS, tubulin, SS | 5.1 |
| 432022 | AL162042 | Hs. 272348 | homo sapiens mRNA, cDNA DKFZp7 | | 5.1 |
| 457579 | AB030816 | Hs. 36761 | HRAS-like suppressor | TM | 5.1 |
| 438484 | AW021671 | Hs. 293330 | ESTs, Weakly similar to p40 [H | | 5.1 |
| 422802 | NM_004278 | Hs. 27008 | phosphatidylinositol glycan, c | DUF158, ank | 5.1 |
| 401724 | | | C16001374 gi|6755086|ref|NP_03 | TM, PLAT, SS | 5.1 |
| 438670 | AI275803 | Hs. 123428 | ESTs | | 5.1 |
| 414757 | U46922 | Hs. 77252 | fragile histidine triad gene | HIT | 5.1 |
| 425098 | AW295349 | Hs. 8038 | ESTs | SS, TM | 5.1 |
| 431896 | AW297844 | Hs. 101428 | ESTs | SS | 5.1 |
| 416732 | H81066 | Hs. 285017 | hypothetical protein FLJ21799 | SS | 5.1 |
| 404571 | | | NM_015902*: Homo sapiens proges | HECT, zf-UBR1, PABP | 5.1 |
| 433675 | AW977653 | Hs. 75319 | ribonucleotide reductase M2 po | SS | 5.1 |
| 426358 | AA376438 | | gb: EST88856 HSC172 cells II Ho | TM | 5.1 |

TABLE 14A-continued

| Pkey | ExAccn | UniGene ID | Unigene Title | Pred Protein Dom | R1 |
| --- | --- | --- | --- | --- | --- |
| 456767 | AI086412 | Hs. 129064 | homo sapiens chromosome 19, co | SS, TM, trypsin, kringle, UPA | 5.1 |
| 412915 | AW087727 | Hs. 74823 | NM_004541 Homo sapiens NADH de | | 5.1 |
| 443553 | AL040535 | Hs. 9573 | ATP-binding cassette, sub-fami | ABC_tran, S5 | 5.1 |
| 415886 | Z42737 | | gb: HSC0SE081 normalized infant | SS | 5.1 |
| 401674 | | | C16001417*: gi|7500345|pir||T21 | FAD-oxidase_C, FAD_binding | 5.1 |
| 424266 | AA337810 | Hs. 149152 | ESTs, Weakly similar to RHOP M | | 5.1 |
| 455035 | AW851734 | | gb: MR2-CT0222-011199-007-e10 C | | 5.1 |
| 408567 | S72921 | | ciliary neurotrophic factor | CNTF | 5.1 |
| 436616 | AW799109 | Hs. 226755 | ESTs | 14-3-3 | 5.1 |
| 409078 | AW327515 | | ESTs | | 5.1 |
| 447976 | AW972653 | Hs. 293691 | ESTs, Highly similar to CR2_HU | | 5.1 |
| 457720 | AA992835 | Hs. 186776 | ESTs | | 5.1 |
| 400528 | | | NM_020975* Homo sapiens ret pr | cadherin, pkinase, SS | 5.1 |
| 407757 | BE048414 | Hs. 165215 | hypothetical protein MGC5395 | SS, EF1G_domain, GST_C, GST_ | 5.1 |
| 452446 | AA086123 | Hs. 297856 | ESTs | rrm, NTF2 | 5.1 |
| 450807 | AI739262 | | gb: wi17b08.x1 NCI_CGAP_Co16 Ho | | 5.1 |
| 432540 | AI821517 | Hs. 105866 | ESTs | SS, TM | 5.1 |
| 449324 | AI638706 | | ESTs, Weakly similar to A47582 | | 5.1 |
| 426434 | M17755 | Hs. 2041 | thyroid peroxidase | EGF, sushi, An_peroxidase, p | 5.1 |
| 407652 | W27953 | Hs. 292911 | ESTs, Highly similar to S60712 | Troponin | 5.1 |
| 443952 | AI149106 | | ESTs | SS, pkinase | 5.1 |
| 448869 | AI792798 | Hs. 12496 | ESTs, Weakly similar to ALU4_H | SS, TM | 5.1 |
| 422837 | U25441 | Hs. 121478 | dopamine receptor D3 | 7tm_1, SS, TM, 7tm_1 | 5.1 |
| 407143 | C14076 | Hs. 332329 | EST | SS, TM | 5.1 |
| 442296 | NM_007275 | Hs. 8186 | lung cancer candidate | SS, TM, Glyco_hydro_56, Glyc | 5.1 |
| 407722 | BE252241 | Hs. 38041 | pyridoxal (pyridoxine, vitamin | pfkB, SS | 5.1 |
| 427336 | NM_005658 | Hs. 2134 | TNF receptor-associated factor | MATH, SS, MATH, A2M_N, A2M, NT | 5.1 |
| 447960 | AW954377 | Hs. 26412 | ring finger protein 26 | SS, TM, Cbl_N, Cbl_N2, Cbl_N3 | 5.1 |
| 400863 | | | C11002296.gi|11692557|gb|AAG39 | SS, TM | 5.1 |
| 409034 | AI684149 | Hs. 172035 | hypothetical protein similar t | SS | 5.1 |
| 421696 | AF035306 | Hs. 106890 | Homo sapiens clone 23771 mRNA | | 5.1 |
| 427587 | BE348244 | Hs. 284239 | ESTs, Weakly similar to 178885 | SS, UDPGT | 5.1 |
| 407204 | R41933 | Hs. 140237 | ESTs, Weakly similar to ALU1_H | SS, histone, histone | 5.1 |
| 454219 | X75042 | Hs. 44313 | v-rel avian reticuloendothelio | RHD, TIG | 5.1 |
| 430513 | AJ012008 | Hs. 241586 | G6C protein | SS, TM, GST_C, abhydrolase | 5.1 |
| 435902 | AA701867 | Hs. 297726 | ESTs | | 5.1 |
| 442743 | AI801351 | Hs. 302110 | ESTs, Weakly similar to MUC2_H | SS, fibrinogen, Rhodanese | 5.1 |
| 454923 | AW897236 | | gb: CM0-NN0057-150400-335-c06 N | SS, Caldesmon | 5.1 |
| 440518 | AA888046 | Hs. 233235 | ESTs | SS, TM | 5.1 |
| 448237 | AI471790 | Hs. 309386 | ESTs | TM, Ribosomal_S7 | 5.1 |
| 428924 | AI016405 | Hs. 98959 | ESTs, Weakly similar to JC5314 | SS, TM, lectin_c | 5.1 |
| 412081 | Z24895 | Hs. 293818 | gb: HSB67F122 STRATAGENE Human | SS, TM, SQS_PSY, GATA | 5.1 |
| 437187 | BE304917 | Hs. 31097 | hypothetical protein FLJ21478 | SS, TM, Glycos_transf_4 | 5.1 |
| 421658 | X84048 | Hs. 301760 | frequenin (Drosophila) homolog | efhand | 5.1 |
| 423467 | AK000214 | Hs. 129014 | hypothetical protein FLJ20207 | SS, TM, GDPD, SS, TM, SH3, PDZ, | 5.0 |
| 417151 | AA194055 | Hs. 293858 | ESTs | PH | 5.0 |
| 408307 | AI761786 | Hs. 204674 | ESTs | Armadillo_seg | 5.0 |
| 404752 | | | NM_024778 Homo sapiens hypothe | | 5.0 |
| 453126 | AA032155 | Hs. 61622 | ESTs | | 5.0 |
| 413983 | BE348384 | Hs. 279194 | ESTs | | 5.0 |
| 405366 | | | NM_003371*: Homo sapiens vav 2 | SS | 5.0 |
| 412425 | AW949156 | | gb: QV4-FT0005-110500-205-b06 F | | 5.0 |
| 437036 | AI571514 | Hs. 133022 | ESTs | SS, TM, Glycos_transf_2 | 5.0 |
| 448455 | AI252625 | Hs. 269860 | ESTs, Moderately similar to S6 | SS, TM | 5.0 |
| 411413 | BE379438 | Hs. 211573 | heparan sulfate proteoglycan 2 | ig, laminin_B, laminin_EGF, | 5.0 |
| 432579 | AF043244 | Hs. 278439 | nucleolar protein 3 (apoptosis | CARD, SS, HSF_DNA-bind, E2F_ | 5.0 |
| 424874 | AA347951 | | Homo sapiens cDNA FLJ20812 fis | SS | 5.0 |
| 408023 | BE018269 | Hs. 279688 | ESTs | | 5.0 |
| 411758 | AW860667 | | gb: QV0-CT0383-210400-204-d03 C | homeobox, homeobox | 5.0 |
| 410660 | AI061118 | Hs. 65328 | Fanconi anemia, complementatio | | 5.0 |
| 427411 | AA402242 | | ESTs | | 5.0 |
| 437018 | AA889078 | | ESTs | SS, TM, ERG4_ERG24 | 5.0 |
| 427029 | AA397596 | | ESTs | SS, ras | 5.0 |
| 452047 | N35953 | Hs. 43510 | ESTs, Weakly similar to BOX B | SS | 5.0 |
| 432093 | H28383 | | gb: yl52c03 r1 Soares breast 3N | Band_41, ERM | 5.0 |
| 453099 | H62087 | Hs. 31659 | thyroid hormone receptor-assoc | SS | 5.0 |
| 441456 | AI458911 | Hs. 127765 | ESTs | | 5.0 |
| 414356 | AW505085 | Hs. 335147 | gb: UI-HF-BN0-als-a-10-0-Ul r1 | SS, TM | 5.0 |
| 434067 | H18913 | Hs. 124023 | Homo sapiens cDNA FLJ14218 fis | | 5.0 |
| 436393 | AW022213 | | ESTs | Galactosyl_T_2 | 5.0 |
| 409227 | AA806165 | Hs. 130323 | Homo sapiens, clone IMAGE 3960 | | 5.0 |
| 448680 | AW245890 | Hs. 21753 | JM5 protein | WD40, SS, TM, KOW, HLH | 5.0 |
| 439343 | AF086161 | Hs. 114611 | hypothetical protein FLJ11808 | | 5.0 |
| 428079 | AA421020 | Hs. 208919 | ESTs | SS, TM, trypsin | 5.0 |
| 421951 | BE327432 | Hs. 109804 | H1 histone family, member X | | 5.0 |
| 427204 | AA405404 | Hs. 215725 | ESTs | SS, SS | 5.0 |
| 409690 | W45393 | Hs. 55888 | activating transcription facto | | 5.0 |

TABLE 14A-continued

| Pkey | ExAccn | UniGene ID | Unigene Title | Pred Protein Dom | R1 |
|---|---|---|---|---|---|
| 436574 | AW293527 | Hs. 126465 | ESTs | | 5.0 |
| 457761 | AW401809 | Hs. 4779 | KIAA1150 protein | SS, LIM, SS | 5.0 |
| 435294 | T84084 | Hs. 196008 | Homo sapiens cDNA FLJ11723 fis | HMG_box | 5.0 |
| 445372 | N36417 | Hs. 144928 | ESTs | SS, PID, PDZ | 5.0 |
| 440511 | AF132959 | Hs. 7236 | eNOS interacting protein | SS, TM, MAGE, Ribosomal_S17, | 5.0 |
| 424437 | BE244700 | Hs. 147049 | cut (Drosophila)-like 1 (CCAAT | CUT, homeobox, beta-lactama | 5.0 |
| 401539 | | | NM_002675.Homo sapiens promyel | zf-B_box, zf-C3HC4, SS | 5.0 |
| 417903 | NM_002342 | Hs. 1116 | lymphotoxin beta receptor (TNF | TNFR_c6, SS | 5.0 |
| 442451 | AI498080 | Hs. 129616 | ESTs | SS | 5.0 |
| 450536 | AI699529 | | gb: tt17a02 x1 NCI_CGAP_GC6 Hom | SS, G-alpha, arf | 5.0 |
| 425169 | AW292500 | Hs. 128514 | ESTs | SS | 5.0 |
| 435262 | AA677088 | | ESTs | | 5.0 |
| 444855 | BE409261 | Hs. 12084 | Tu translation elongation fact | GTP_EFTU GTP_EFTU_D3, GTP_ | 5.0 |
| 433507 | AI817336 | Hs. 191791 | ESTs | pkinase | 5.0 |
| 432396 | AW295956 | Hs. 11900 | hypothetical protein FLJ14972 | SS | 5.0 |
| 438395 | AA017514 | Hs. 6211 | methyl-CpG binding domain prot | MBD, zf-CXXC, SS, zf-CXXC | 5.0 |
| 446603 | NM_014835 | Hs. 15519 | oxysterol-binding protein-rela | Oxysterol_BP, SS | 5.0 |
| 400762 | | | Target Exon | | 5.0 |
| 440133 | AI056255 | Hs. 133349 | ESTs | | 5.0 |
| 445903 | AI347487 | Hs. 132781 | class I cytokine receptor | SS, TM, EF1BD | 5.0 |
| 412940 | BE295701 | Hs. 819 | homo box B7 | homeobox, SS, homeobox, home | 5.0 |
| 419269 | AA235838 | | gb: zs41b04 s1 Soares_NhHMPu_S1 | TM | 5.0 |

Pkey. Unique Eos probeset identifier number
ExAccn: Exemplar Accession number, Genbank accession number
UnigeneID Unigene number
Unigene Title Unigene gene title
Pred. Protein Dom Predicted protein domain
R1 Ratio of tumor to normal body tissue

TABLE 14B

| Pkey | CAT Numver | Accession |
|---|---|---|
| 408117 | 104000_1 | AL138255 BE380045 AA047314 D82381 T18585 H64978 T10798 |
| 408215 | 10478_1 | BE614290 AA307674 N35629 AA338538 AI193603 AA781096 AI680061 AI613258 AW276647 BE221263 AI348910 AI985031 AI090078 AI359617 AA666391 AI160210 AI446461 AI355345 AI343638 AI343640 AI275091 M78746 AW262795 AW250002 AA503756 AI934519 AW272086 N26520 AA626639 |
| 408270 | 1049980_1 | AW177805 AW177895 AW177816 AW177901 BE141597 BE141584 AW177822 AW177818 AW177899 |
| 408294 | 1050553_1 | BE141732 U75823 BE141331 AW178416 AW178430 BE141343 BE141298 BE141702 BE141285 |
| 408567 | 10663_1 | S72921 NM_000614 X55889 X60542 X60477 |
| 409078 | 1098756_1 | AW327515 AW327774 AW327571 |
| 409164 | 110421_1 | AA706639 AA064707 AL036920 AI651598 |
| 409679 | 114787_1 | BE250521 AA076837 BE249870 AA984291 AW502442 AW501551 AI221491 AA194239 D63046 AA193426 AA773243 AA193293 |
| 409832 | 115564_1 | AW963293 AI866310 AA077791 AA362540 |
| 410445 | 120374_2 | AA199830 AI143895 AW961629 AA322482 |
| 410471 | 1204721_1 | T88872 AW749857 |
| 410895 | 1226051_1 | AW809679 AW809678 AW810113 AW810182 AW809900 AW809851 AW810110 AW810228 AW810342 AW810181 AW809632 AW809745 AW810372 AW809681 AW809792 AW809806 AW810452 AW809675 AW809964 AW810033 AW810111 AW809846 AW809847 AW809717 |
| 411219 | 1236055_1 | AW832917 AW832913 AW832906 AW832788 AW832915 AW832917 |
| 411298 | 1237955_1 | AW835858 AW835836 AW835823 AW835834 AW835831 AW835832 AW835843 AW835816 AW835833 AW835815 AW835849 AW835835 AW835848 AW835851 AW835852 AW835862 AW835855 AW835825 AW835847 AW835838 |
| 411426 | 1245515_1 | BE141714 AW845993 AW845989 |
| 411456 | 1246706_1 | AW847588 AW847716 AW847664 AW847592 |
| 411490 | 1247426_1 | R39474 AW848420 R76943 |
| 411605 | 125123_2 | AW006831 AA678298 R12579 W86152 AI123683 AA699780 AI672156 BE092587 AA094230 AI633815 AA526153 W86151 |
| 411758 | 1256751_1 | AW860667 AW860665 |
| 412091 | 1276564_1 | R06185 AW891805 AW901892 AW901895 |
| 412122 | 127838_2 | AW852707 N57282 AA725075 AI703492 AW612137 AI696372 AI879394 AI653605 W26914 |
| 412128 | 1278726_1 | AW894709 N78140 |
| 412173 | 1280870_1 | T71071 AW902279 AW897608 |
| 412425 | 1293726_1 | AW949156 AW949003 AW949008 |
| 412452 | 129707_1 | AA215731 N48523 AA307559 AA130794 BE296746 BE378396 AA190411 AI904194 AA311805 AI356291 AA446714 AI818924 AI609152 AW771476 BE298184 AA295023 AA130708 AI078381 AA114156 AI198283 AA215665 AI201085 AI694848 AI077572 AA102778 AW016425 AI923123 AA577072 AI671 |
| 412777 | 132672_1 | AI335773 AI288496 AA120880 |
| 412934 | 1337389_1 | BE011437 BE011402 BE011395 BE011428 BE011407 BE011421 BE011406 |
| 413272 | 135718_1 | AA127923 AA127846 AA534131 N53566 AA533669 AW511251 AI174441 AA127875 AI685293 AA127913 N72525 AW770386 N69010 AW070312 H80275 H80289 AA972923 |

TABLE 14B-continued

| Pkey | CAT Numver | Accession |
|---|---|---|
| 413534 | 1375357_1 | BE146961 BE146780 BE146788 BE146967 BE146774 BE146963 BE146907 |
| 413564 | 1376722_1 | BE260120 BE148538 |
| 414347 | 1437406_1 | BE275835 BE390063 BE388764 BE409101 |
| 414371 | 14388_8 | AI905865 BE294801 BE562308 BE297957 AW157051 AI815883 AW162529 BE439610 AW157225 AW157210 AW162675 AW161998 AI816168 AW162599 AI816004 AI815820 AW162158 AW162339 M17733 AW157639 AI879416 BE258811 AW157436 AW162433 AW161633 AW162155 AW157410 AW157269 AW162 |
| 414391 | 1441921_1 | BE409872 BE281460 |
| 414413 | 1443696_1 | BE294877 BE294759 |
| 414593 | 1464909_1 | BE386764 BE387560 |
| 414944 | 1509480_1 | C15044 D80943 C15696 |
| 415126 | 1523506_1 | D60945 D61346 D81568 D80539 |
| 415611 | 1540555_1 | T26376 F12852 T75058 |
| 415886 | 1560411_1 | Z42737 T08986 H07956 |
| 415958 | 1563222_1 | H10942 Z42911 R60453 |
| 416233 | 158010_1 | AA176633 AW961842 AA309418 |
| 416597 | 1603081_1 | H66891 R98149 H68467 |
| 417739 | 1696198_1 | Z43995 R12357 R34740 |
| 418184 | 172744_1 | AA367375 AA486701 BE152479 BE152800 AW816961 AA214097 |
| 418304 | 173658_2 | AA215702 AA368006 AA215703 BE066555 BE006876 |
| 419269 | 183444_1 | AA235838 BE180775 |
| 419516 | 185533_1 | H82550 N43802 AA243820 AL040762 N24315 U66692 |
| 420530 | 19446_1 | AI218431 AA432232 AW183040 X86012 AA868831 AI191788 AA912999 AI204297 AI205744 AI218259 AA428596 AA993742 AA703660 AI018669 AA879431 |
| 421879 | 208649_1 | AW959607 AA299654 AA579966 |
| 423790 | 232031_1 | BE152393 AA330984 BE073904 |
| 424874 | 244523_1 | AA347951 AI688463 AA883123 |
| 426221 | 26281_1 | AB007881 U32581 AW131202 AW995994 W31964 N24261 AI033045 H98694 AW364848 AI222031 AA907216 AI215730 AA776981 AW473826 W31373 |
| 426358 | 265504_1 | AA376438 AA376324 AW963848 AW834782 |
| 426576 | 269378_1 | AA381720 AA382040 AW963564 |
| 427029 | 274544_1 | AA397596 AI198827 AA435832 |
| 427326 | 277229_1 | AI287878 AI804160 AA400787 |
| 427411 | 278474_1 | AA402242 AA813659 AI150316 AA412054 |
| 428092 | 286920_1 | AW879141 AA421182 AI734104 AI733923 AA430600 |
| 428304 | 289603_1 | AI743177 AA425743 AI804283 AI743189 |
| 428948 | 29737_1 | BE514362 AI879343 BE272870 BE616390 AW163444 AW161588 AW378754 AW238803 BE267205 BE047746 BE207213 BE312782 BE266301 BE266413 BE278348 BE280885 BE278833 BE281417 BE407786 BE378176 BE392818 AW377597 BE395951 BE393978 AW327483 BE394175 BE385795 BE275663 BE3 |
| 429398 | 303954_1 | AA452239 AI262173 AI925886 AI469041 H96628 AI768463 AI671422 AI915624 AA766891 AA521087 AA814103 AW993151 AW005927 |
| 430168 | 313927_1 | AW968343 AA468507 AI478223 AW513008 AI762122 AI554512 AA862642 AA468976 |
| 431082 | 327710_1 | AA491600 AA491645 AI920986 |
| 431161 | 328713_1 | AA493591 AA829120 AA533792 |
| 431424 | 333110_1 | AI222969 AA806560 AA504839 AA805261 |
| 431627 | 33581_1 | AW609720 AW609735 AA082767 N88831 R23418 N55837 BE549484 AW816584 AW816947 AW816897 |
| 432093 | 341283_1 | H28383 AW972670 H28359 AA525808 |
| 432945 | 356589_1 | AL043683 AA570698 AA907496 AL043682 AW362288 |
| 433168 | 360235_1 | AI085436 AA579438 AA579002 |
| 433357 | 36402_1 | T05639 AF024702 |
| 434315 | 383402_1 | AW196608 AA884617 AA758108 AI126321 AA629291 AW196549 AI208031 |
| 434743 | 3925_1 | AI363410 AI356019 H00141 T78748 AL049365 AL079911 AI750972 Z42602 AW452523 AI223826 AA215407 AI633829 AA292122 N42783 AW505595 AF086096 N90340 N63271 AA131836 AW607273 AA527132 T32315 AA421961 T34951 AW966080 M78807 N31947 AA521151 AA278866 AA044784 AA700 |
| 434796 | 393400_1 | AA812046 AW974514 AA764999 AA649302 |
| 435186 | 402143_1 | AL119470 AA669492 AI628351 AI263835 AL119498 |
| 435262 | 403605_1 | AA677088 AI022246 AA677107 |
| 435339 | 404485_1 | AI358300 AI762981 AA678073 AA988621 |
| 436094 | 414444_1 | AI798701 AW008826 AA704731 |
| 436389 | 41894_1 | AI811706 AW297940 AJ227887 AA875850 AA228803 AI610234 AI921618 AI768606 N37039 AA081104 BE172693 D56503 Z28585 T95651 AA292389 AA293502 N28751 |
| 436393 | 41903_1 | AW022213 AI274032 AJ227898 AI160412 AI084451 |
| 437018 | 431333_1 | AA889078 AA907263 AA742199 |
| 437050 | 432210_1 | AA766420 AA743319 AW976442 |
| 437215 | 43473_1 | AL117488 AL044479 |
| 437662 | 440374_1 | AA765387 AA832241 AI222134 AI216405 AI685043 |
| 437834 | 443674_1 | AA769294 AW749299 AW749302 AW749295 AW749304 AW749293 AW749298 AW749294 AW749288 AW749291 AW749297 AW749292 AW749296 AW749289 AW749287 BE535498 |
| 438118 | 450293_1 | AW753311 AW663081 AA778411 |
| 438723 | 46392_1 | M34429 M34431 M34432 M25802 AW938720 |
| 439034 | 46802_1 | AF075083 H52291 H52528 |
| 439150 | 46919_1 | AF086006 H64722 H65212 H66282 |
| 439469 | 47274_1 | W69836 AF086287 W69657 |
| 440317 | 49187_1 | BE561888 BE560615 BE562102 |

TABLE 14B-continued

| Pkey | CAT Numver | Accession |
|---|---|---|
| 440546 | 496976_2 | AI491994 AW139809 AA889258 AI700895 |
| 441358 | 515468_1 | AW173212 AA983948 AI080705 AA931334 |
| 441523 | 519049_1 | AW514263 AI567908 AI299828 AI299043 N51706 AA936483 |
| 441794 | 526289_1 | AW197794 AW195867 AW197787 AA968466 |
| 442146 | 533972_1 | R52599 T65201 F11984 F13186 AA977679 T77028 H12167 |
| 442318 | 538584_1 | AI792199 AI733491 AA991378 |
| 442472 | 543371_1 | AW806859 AW806852 AF049582 |
| 442780 | 551405_1 | AI017521 AI017613 AW511133 |
| 442893 | 553987_1 | H78133 H90849 AI023482 |
| 443952 | 586524_1 | AI149106 AI500318 AI334156 AI093029 AI765679 AI769652 AI167308 AI128885 |
| 444406 | 605004_1 | AI147237 AI800517 |
| 445099 | 629785_1 | BE163341 AI207756 BE171477 |
| 445625 | 64558_1 | BE246743 AA436942 AW024744 AW242177 AA975476 AW385185 R07536 R73462 AV654529 T57442 AI399986 R50073 R48743 AI769689 AI863005 AA317806 AI678000 AW189963 AI986207 AW471273 R73463 AI335104 AI590161 AI469257 AI954604 H21954 T25141 AA856793 R50074 AI708253 AI2 |
| 445631 | 6457_1 | AK001822 AW860325 AA335296 AW965531 AW130957 AW193951 AI347975 AW081323 AW662527 AI343924 AI380749 AA938153 T66966 AI655000 AW418837 AI380485 AA410698 AI520726 BE501355 AI637925 AW779200 AI524755 AW593995 AI336927 AI336928 AI357036 R60592 H19058 R11124 T1 |
| 445837 | 652068_1 | AI261700 AI793196 AI469160 AI793007 |
| 446780 | 692897_1 | R31107 AI341136 AI653198 H04953 |
| 446790 | 693032_1 | AW452105 AI341280 AI917445 |
| 447045 | 70510_1 | AW392394 AW579531 AW382131 AA010316 BE146145 AW579562 AW579577 BE146152 BE146040 BE145972 BE146099 AW003280 AA868470 BE146306 T85009 AI087294 BE146299 BE146319 BE146307 W44912 AI703134 AW026017 BE382873 AA903733 AI655933 BE551223 AA847664 AW173582 AW57240 |
| 447128 | 70934_1 | AI271898 BE048502 AI452509 AI244810 X84721 AI858001 AI553937 AA149853 H00719 AI765259 AW973696 F25787 F35749 AI568815 AW015380 AA554539 C00201 AA961610 AW059537 R77127 |
| 447904 | 741913_1 | AW206303 AW207644 AI765705 |
| 448330 | 758690_1 | AL036449 AW016705 AI492482 |
| 448993 | 79225_1 | AI471630 BE540637 BE265481 AW407710 BE513882 BE546739 AA053597 BE140503 BE218514 AW956702 AI656234 AI636283 AI567265 AW340858 BE207794 AA053085 R69173 AA292343 AA454908 AA293504 AI659741 AI927478 AA399460 AI760441 AA346416 BE047245 AA730380 AA394063 AA454 |
| 449324 | 804806_1 | AI638706 BE550292 R11026 |
| 449495 | 808345_1 | AI652833 AI695904 AW888916 |
| 450251 | 829987_1 | BE080483 BE080416 AI689298 |
| 450536 | 837848_1 | AI699529 BE161564 BE077251 |
| 450807 | 847591_1 | AI739262 R28418 |
| 451045 | 85673_1 | AA215672 AI696628 AA013335 H86334 AA017006 |
| 451752 | 8835_1 | AB032997 N74056 BE467119 AW237035 AI141678 AA934774 AW978722 AI761408 H09497 AI934521 AA716567 H62600 AI479668 Z40632 AA832081 Z44858 H09496 BE395335 AW295901 BE465977 AI621269 BE465983 M79058 H62533 AA325444 |
| 452113 | 899664_1 | AI859393 BE177742 |
| 453413 | 966269_1 | AJ003294 AJ003315 AJ003293 |
| 453829 | 982731_1 | AL138200 T71830 T71828 |
| 453904 | 986581_1 | AW003821 AW027475 AW025661 |
| 454438 | 120132_1 | AA224053 AA114150 AA214275 AA224027 T58431 AA211908 AA669657 AA199744 AA630511 AA164864 T58463 AA214394 AA161378 AA161386 AA205211 AA167824 AA084940 AA223625 AA191190 AA309486 AW961804 |
| 454453 | 1206827_1 | AW752781 BE143749 AW752727 AW752559 AW752578 AW752584 R45742 |
| 454577 | 1225673_1 | AW809272 AW809169 AW809179 AW809192 AW809166 AW809172 AW809191 AW809165 AW809197 AW809181 AW809237 AW809226 AW809250 AW809199 AW809259 AW809239 AW809273 AW809270 AW809147 AW809188 AW809245 |
| 454682 | 1228976_1 | AW816029 AW813292 AW816156 AW813333 AW816159 AW813302 |
| 454718 | 1230532_1 | AW815144 AW815150 AW861007 |
| 454756 | 1233646_1 | AW819273 AW819283 AW819287 AW819281 AW819274 AW819282 AW819277 AW819286 |
| 454923 | 1245024_1 | AW897236 AW845406 |
| 455035 | 1249762_1 | AW851734 AW851676 AW851693 AW851713 AW851722 AW851616 AW851731 AW851618 AW851648 AW852215 |
| 455274 | 1272212_1 | BE151622 BE151636 AW885648 |
| 455286 | 1273576_1 | BE144384 AW887474 AW887403 BE144386 |
| 455557 | 1325974_1 | AW995839 AW995907 |
| 455604 | 1337197_1 | BE011183 BE011170 BE011333 BE011188 BE011181 BE011324 BE011161 BE011169 |
| 455679 | 1349914_1 | BE066529 BE066274 BE066390 BE066356 BE066419 BE066345 BE066298 BE066292 BE066359 |
| 455778 | 1364506_1 | BE088746 BE088802 BE088755 BE088876 BE088947 BE088881 BE088952 |
| 455885 | 1380385_1 | BE153524 BE153576 BE153583 |
| 456487 | 19270_1 | AF064804 AA320309 N89343 AA564588 AF069734 AA349248 AW964366 T98541 AW511100 T98542 AW070452 AA013172 AI767005 T32140 W05727 T30969 T30970 N74883 AA903211 AI392796 AI434622 AA829283 |
| 457892 | 432926_1 | AA744389 AA744270 AA744284 AA744299 AA745380 AA744337 AA846905 AA847698 |
| 457978 | 448900_1 | AA776638 BE439540 |

TABLE 14B-continued

| Pkey | CAT Numver | Accession |
|---|---|---|
| 458198 | 504834_1 | AI286100 AA952934 AA918305 |
| 458644 | 670856_1 | AW270149 AW664628 AI285912 |

Pkey: Unique Eos probeset identifier number
CAT number Gene cluster number
Accession Genbank accession numbers

TABLE 14C

| Pkey | Ref | Strand | Nt_position |
|---|---|---|---|
| 400460 | 8389428 | Plus | 35559–36295 |
| 400500 | 9796136 | Minus | 120238–120495 |
| 400528 | 6981824 | Plus | 472381–472528, 474170–474277, 475328–475542, 475878–476000 |
| 400668 | 8118719 | Plus | 121756–122043 |
| 400748 | 8119063 | Plus | 84237–84398 |
| 400762 | 8131616 | Plus | 7235–7605 |
| 400772 | 8131629 | Minus | 34896–35021, 41078–41197 |
| 400833 | 8705148 | Minus | 187599–188138 |
| 400863 | 9798616 | Plus | 21575–22330 |
| 400906 | 9966290 | Plus | 112863–112989, 120162–120286 |
| 400923 | 7637836 | Minus | 94518–94659 |
| 401121 | 8570296 | Plus | 57211–57525 |
| 401180 | 9438648 | Minus | 150981–152128 |
| 401203 | 9743387 | Minus | 172961–173056, 173868–173928 |
| 401210 | 7712287 | Plus | 166969–167133, 169760–169877, 171563–171733 |
| 401215 | 9858408 | Plus | 103739–103919 |
| 401264 | 9797154 | Plus | 130810–130927, 133367–133504 |
| 401278 | 9799936 | Plus | 98428–98573 |
| 401349 | 9930791 | Plus | 72440–73030 |
| 401402 | 7710964 | Plus | 75730–76077 |
| 401488 | 7341775 | Plus | 54523–54686, 55364–55451, 55737–55846, 58047–58175, 58261–58356 |
| 401507 | 7534110 | Plus | 71055–71259 |
| 401539 | 8072433 | Minus | 62028–62608 |
| 401553 | 8099284 | Minus | 83990–84161 |
| 401594 | 7230963 | Plus | 7997–8170 |
| 401674 | 7689903 | Plus | 138786–138927, 139157–139298, 139440–139599, 139960–140159 |
| 401677 | 9965537 | Minus | 62856–63086, 63603–63884 |
| 401722 | 7656694 | Plus | 143861–144054 |
| 401724 | 7656694 | Plus | 150063–150241 |
| 401822 | 6730824 | Plus | 88400–89959 |
| 401885 | 8140731 | Plus | 148234–148321, 150365–150559 |
| 401935 | 3808091 | Plus | 46329–48473 |
| 401938 | 6102666 | Plus | 151891–152032 |
| 401984 | 4454511 | Plus | 103825–104024 |
| 402189 | 8576043 | Minus | 128318–129601 |
| 402197 | 8576113 | Plus | 199466–199585 |
| 402285 | 2689079 | Minus | 92386–92634 |
| 402365 | 9454515 | Minus | 70928–71185 |
| 402445 | 9796614 | Plus | 90925–91064, 91172–91331 |
| 402501 | 9797862 | Plus | 8601–8876 |
| 402545 | 9838114 | Minus | 48547–48678, 50604–50737, 51384–51467 |
| 402651 | 7960391 | Plus | 174215–174380 |
| 402916 | 7406502 | Minus | 361–474, 541–687 |
| 403003 | 5441423 | Minus | 79403–79560, 79712–80021 |
| 403128 | 7331426 | Plus | 122884–123018, 123134–123283, 123372–123695, 123779–123940, 124059–124256 |
| 403672 | 7283286 | Minus | 96600–96881, 96951–97280, 97393–97594 |
| 403748 | 7658423 | Minus | 129503–130344 |
| 403885 | 7710403 | Minus | 53259–53524 |
| 403938 | 7711795 | Plus | 48636–48822 |
| 404001 | 8655948 | Minus | 137995–138317 |
| 404066 | 3367505 | Minus | 71040–71288 |
| 404149 | 7534008 | Plus | 121831–121951, 124044–124150 |
| 404199 | 6010176 | Minus | 1669–2740 |
| 404311 | 8570412 | Minus | 149189–149303 |
| 404333 | 9802821 | Minus | 137948–138024, 138111–138300 |
| 404365 | 9964977 | Plus | 50151–50319, 50859–51098 |
| 404430 | 7407979 | Plus | 42921–43109 |
| 404438 | 6984205 | Plus | 63413–63553 |
| 404571 | 7249169 | Minus | 112450–112648 |
| 404596 | 9958262 | Minus | 104807–105043 |
| 404676 | 9797204 | Minus | 56167–56342, 58066–58189, 58891–59048, 60452–60628 |
| 404710 | 9801097 | Minus | 45190–45339, 47509–47622, 48137–48264, 48805–48946, 50073–50345, 51467–51588 |
| 404752 | 7109522 | Minus | 120168–120326 |
| 404807 | 4165210 | Minus | 124246–124422 |
| 404956 | 7387343 | Plus | 55883–56203 |
| 405085 | 8072509 | Minus | 44045–44230 |
| 405113 | 8096927 | Plus | 170073–170894 |
| 405143 | 9438278 | Plus | 5894–5983, 7355–7427 |
| 405159 | 9966252 | Plus | 79659–79804 |
| 405211 | 6692345 | Minus | 31340–32609 |
| 405247 | 7249301 | Minus | 65578–65778, 68088–68234 |
| 405346 | 2981263 | Plus | 101982–102171 |
| 405366 | 2182280 | Plus | 22478–22632 |
| 405371 | 2078469 | Minus | 47657–47766, 48461–48596 |
| 405375 | 1552539 | Plus | 11646–12050, 12207–12485 |
| 405376 | 1552533 | Plus | 28875–29099 |
| 405473 | 8439781 | Plus | 153074–153343, 154501–154598, 156879–156999, 158863–159051, 159910–160053, 161109–161229, 163035–163131, 165163–165259, 165868–166003, 167375–167552, 169252–169364, 171127–171281 |
| 405474 | 8439781 | Plus | 172005–172175 |
| 405557 | 1621108 | Plus | 39883–40047 |
| 405637 | 6289229 | Plus | 189852–189978 |
| 405770 | 2735037 | Plus | 61057–62075 |
| 405928 | 7717155 | Minus | 2923–3209 |
| 405931 | 6758795 | Minus | 148233–148705 |
| 405939 | 6758795 | Plus | 170500–170654 |
| 406109 | 9127147 | Minus | 58328–58485 |
| 406230 | 4760409 | Plus | 71716–72515 |
| 406284 | 7549620 | Plus | 74002–74199 |
| 406299 | 5686278 | Minus | 35655–36119 |
| 406301 | 8575868 | Plus | 57291–57494 |
| 406373 | 9256130 | Plus | 188922–189152 |
| 406495 | 7711328 | Minus | 174661–174978 |
| 406575 | 7711679 | Plus | 142034–142473 |

Pkey: Unique number corresponding to an Eos probeset
Ref: Sequence source The 7 digit numbers in this column are Genbank Identifier (GI) numbers "Dunham I et al" refers to the publication entitled "The DNA sequence of human chromosome 22" Dunham, et al. (1999) Nature 402 489–495
Strand Indicates DNA strand from which exons were predicted
Nt_position Indicates nucleotide positions of predicted exons Table 15A lists about 933 genes up-regulated in ovarian cancer compared to normal adult tissues that are likely to encode extracellular or cell-surface proteins These were selected as for Table 14A, except that the ratio of "average" ovarian cancer to "average" normal adult tissues was greater than or equal to 3 0, the "average" ovarian cancer level was set to the 96th percentile value amongst various ovarian cancer specimens, the "average" normal adult tissue level was set to the 75th percentile value amongst various non-malignant tissues, the "average" ovarian cancer value was greater than or equal to 400 units (this selects for the most abundant of the up-regulated genes), and the predicted protein contained a structural domain that is indicative of extracellular localization (e g, ig, fn3, efg, 7tm domains, signal sequences, transmembrane domains). Predicted protein domains are noted.

TABLE 15A

| Pkey | ExAccn | UniGene ID | Unigene Title | Pred Protein Dom | R1 |
|---|---|---|---|---|---|
| 407223 | H96850 | | gb: yw03b12 s1 Soares melanocyt | SS, TM, SS, TM, DDOST_48 kD | 58.9 |
| 421296 | NM_002666 | Hs. 103253 | perilipin | perilipin, SS | 47.6 |
| 430281 | AI878842 | Hs. 237924 | CGI-69 protein | mito_carr, SS, TM | 46.7 |
| 410418 | D31382 | Hs. 63325 | transmembrane protease, serine | SS, TM, ldl_recepta, trypsi | 41.0 |
| 431773 | BE409442 | Hs. 268557 | pleckstrin homology-like domai | PH, SS, LIM, Troponin | 37.1 |
| 428758 | AA433988 | Hs. 98502 | CA125 antigen, mucin 16 | SS | 35.6 |
| 438424 | AI912498 | Hs. 25895 | hypothetcal protein FLJ 14996 | SS, TM | 35.3 |
| 450461 | BE408081 | Hs. 46736 | hypothetical protein FLJ23476 | SS | 34.4 |
| 437897 | AA770561 | Hs. 146170 | hypothetical protein FLJ22969 | SS, TM, zf-DHHC | 33.9 |
| 452554 | AW452434 | Hs. 58006 | ESTs, Weakly similar to ALU5_H | SS, PAS, HLH | 32.5 |
| 422310 | AA316622 | Hs. 98370 | cytochrome P450, subfamily IIS | SS, TM, pkinase, fn3, ig | 30.5 |
| 452849 | AF044924 | Hs. 30792 | hook2 protein | bZIP, SS, AhpC-TSA | 29.6 |
| 407722 | BE252241 | Hs. 38041 | pyridosal (pyridoxine, vitamin | pfkB, SS | 28.2 |
| 416819 | U77735 | Hs. 80205 | pim-2 oncogene | pkinase, SS, TM, OTU, K_tetra | 27.9 |
| 430397 | AI924533 | Hs. 105607 | bicarbonate transporter relate | HCO3_cotransp, SS, TM | 27.7 |
| 427725 | U66839 | Hs. 180533 | mitogen-activated protein kina | pkinase | 27.5 |
| 454017 | AW023617 | Hs. 347130 | bypothetical protein FLJ22709 | SS, TM, myosin_head, RA, DAG_ | 27.2 |
| 445434 | BE391690 | Hs. 9265 | hypothetical protein FLJ20917 | SS, PWWP, Exonuclease, lipoc | 26.8 |
| 452399 | BE513301 | Hs. 29344 | hypothetical protein, clone 24 | SS, perilipin | 26.5 |
| 419451 | AI907117 | Hs. 90535 | syntaxin binding protein 2 | Sec1, SS, TM | 25.1 |
| 424420 | BE614743 | Hs. 146688 | prostaglandin E synthase | MAPEG, SS, TM, MAPEG | 25.1 |
| 407893 | BE408359 | Hs. 43621 | *Homo sapiens*, Similar to hypot | SS, SS, arf, ras, fn3, ras | 25.0 |
| 412674 | X04106 | Hs. 74451 | calpain 4, small subunit (30 K) | efhand, SS, CAP_GLY | 24.4 |
| 430023 | AA158243 | Hs. 227729 | FK506-binding protein 2 (13 kD) | SS, FKBP, SS, PDGF, C2, PI-PLC | 24.3 |
| 444672 | Z95636 | Hs. 11669 | laminin, alpha 5 | laminin_EGF, laminin_G, EGF | 24.0 |
| 413726 | AJ278465 | Hs. 75510 | annexin A11 | annexin, SS, annexin | 23.1 |
| 438951 | U51336 | Hs. 6453 | inositol 1,3,4-triphosphate 5/ | SS, oxidored_nitro, SS | 23.0 |
| 429099 | BE439952 | Hs. 196177 | phosphorylase kinase, gamma 2 | pkinase, SS, SNF2_N, helicas | 23.0 |
| 422645 | L40027 | Hs. 118890 | glycogen synthase kinase 3 alp | pkinase, Ets | 22.4 |
| 427899 | AA829286 | Hs. 332053 | serum amyloid A1 | SS, SAA_proteins, SS, SAA_pr | 22.2 |
| 407117 | AA146625 | | gb: zo71c07.s1 Stratagene pancr | SS | 21.3 |
| 402916 | | | ENSP00000202587*: Bicarbonate t | HCO3_cotransp, SS | 20.8 |
| 425760 | D17629 | Hs. 159479 | galactosamine (N-acetyl)-6-sul | Sulfatase, SS, TM | 20.7 |
| 422098 | H03117 | Hs. 111497 | similar to mouse neuronal prot | TM | 20.6 |
| 442232 | AI357813 | Hs. 337460 | ESTs, Weakly similar to A47582 | SS, TM, TGFb_propeptide, TGF | 20.1 |
| 453157 | AF077036 | Hs. 31989 | DKFZP586G1722 protein | SS, Tropomyosin | 20.0 |
| 422179 | AF091619 | Hs. 112667 | dynein, axonemal, intermediate | WD40, SS | 20.0 |
| 419444 | NM_002496 | Hs. 90443 | Target CAT | fer4, SS, TM, V_ATPase_sub_a | 19.5 |
| 416893 | AA455588 | Hs. 62406 | hypothetical protein FLJ22573 | SS, rrm, SS | 19.2 |
| 434030 | AW162336 | Hs. 3709 | low molecular mass ubiquinone- | SS | 19.1 |
| 411813 | NM_014931 | Hs. 72172 | KIAA1115 protein | SS, TM, Y_phosphatase | 18.9 |
| 422305 | AI928242 | Hs. 293438 | ESTs, Highly similar to AF1984 | SS | 18.8 |
| 419167 | AI589535 | Hs. 94875 | ESTs, Weakly similar to A35363 | SS | 18.6 |
| 406663 | U24683 | | immunoglobulin heavy constant | SS | 18.5 |
| 429712 | AW245825 | Hs. 211914 | ENSP00000233627* NADH-ubiquino | oxidored_q6, SS, TM, rrm | 18.5 |
| 425848 | BE242709 | Hs. 159637 | valyl-tRNA synthetase 2 | GSt_C, GST_N, Tropomyosin, S | 18.4 |
| 447151 | AI022813 | Hs. 92679 | *Homo sapiens* clone CDABP0014 m | SS, TM, LRR, aminotran_1_2 | 18.4 |
| 413343 | BE392026 | Hs. 334346 | hypottiehcal protein MGC13045 | SS, DnaJ | 18.2 |
| 450209 | AW073380 | Hs. 267963 | hypothetical protein FLJ10535 | SS, Pyridox_oxidase, zf-C2H | 17.7 |
| 427721 | AI582843 | Hs. 180455 | RAD23 (*S. cerevisiae*) homolog | ubiquitin, UBA, integrin_B, | 17.6 |
| 443780 | NM_012068 | Hs. 9754 | activating transcription facto | bZIP, NTP_transf_2, SS, TBC | 17.2 |
| 421612 | AF161254 | Hs. 106196 | 8D6 antigen | ldl_recept_a, SS, TM | 17.1 |
| 444607 | AW405635 | Hs. 293687 | ESTs | SS, PI-PLC-X, PH, PI-PLC-Y, C | 16.7 |
| 406621 | X57809 | Hs. 181125 | immunoglobulin lambda locus | SS | 16.6 |
| 443496 | AJ006973 | Hs. 9482 | target of myb1 (chicken) homol | VHS, GAT, TM, Heme_oxygenase | 16.6 |
| 440104 | AA132838 | Hs. 239894 | hypothetical protein MGC2803 | SS, DS | 16.3 |
| 427640 | AF058293 | Hs. 180015 | D-dopachrome tautomerase | MIF, late_protein_L2, SS, GS | 16.2 |
| 445625 | BE246743 | | hypothetical protein FLJ22635 | SS, TM | 16.1 |
| 427461 | AA531527 | Hs. 332040 | hypothetical protein MGC13010 | SS, TM, ACAT, LRR | 15.9 |
| 423366 | Z80345 | Hs. 127610 | acyl-Coenzyme A dehydrogenase, | Acyl-CoA_dh, Acyl-CoA_dh_M | 15.7 |
| 409017 | T86957 | Hs. 272299 | hypothetical protein RP4-622L5 | SS, TM | 15.6 |
| 428167 | AA770021 | Hs. 16332 | ESTs | SS, ig, fn3 | 15.5 |
| 420029 | BE258876 | Hs. 94446 | polyamine-modulated factor 1 | aldo_ket red, SS, TM, gla | 15.5 |
| 400460 | | | C11002253*: gi|129091|sp|P23267 | SS, TM, SCAN, zf-C2H2, KRAB | 15.4 |
| 407767 | W15398 | Hs. 38628 | hypothetical protein | SS, zf-CCCH | 15.4 |
| 406918 | M88357 | | gb: *Homo sapiens* DNA-binding pr | zf-C2H2, SS | 15.4 |
| 435158 | AW663317 | Hs. 65588 | DAZ associated protein 1 | rrm, SS, rrm | 15.3 |
| 407619 | AL050341 | Hs. 37165 | collagen, type IX, alpha 2 | SS, Collagen, SS, Collagen | 15.3 |
| 421273 | AJ245416 | Hs. 103106 | U6 snRNA-associated Sm-like pr | Sm, SS, tRNA-synt_1, GST_C, G | 15.1 |
| 402365 | | | Target Exon | SS, SS, TM, ig | 14.9 |
| 450503 | R35917 | Hs. 301338 | hypothetical protein FLJ12587 | SS | 14.8 |

TABLE 15A-continued

| Pkey | ExAccn | UniGene ID | Unigene Title | Pred Protein Dom | R1 |
|---|---|---|---|---|---|
| 427502 | AI811865 | Hs. 7133 | Homo sapiens, clone IMAGE 3161 | SS, TM, ABC_tran, Glyco_tran | 14.6 |
| 432872 | AI908984 | Hs. 279623 | selenoprotein X, 1 | DUF25, SS, Ribosomal_L3, PDZ | 14.5 |
| 439233 | AA831893 | Hs. 292767 | hypothetical protein FLJ23109 | zf-C3HC4, TM, Sulfate_trans | 14.5 |
| 416897 | M78146 | Hs. 324700 | hypothetical protein MGC2663 | SS | 14.3 |
| 447304 | Z98883 | Hs. 18079 | phosphatidylinositol glycan, c | SS, Peptidase_C2 | 14.2 |
| 431543 | AW969619 | Hs. 259768 | adenylate cyclase 1 (brain) | TM | 14.0 |
| 447544 | AA401573 | Hs. 288284 | hypothetical protein FLJ22378 | SS, TM | 14.0 |
| 417595 | AA424317 | Hs. 6259 | KIAA1698 protein | SS, TM, Glyco_hydro_31, Glyc | 13.8 |
| 436127 | W94824 | Hs. 11565 | RIKEN cDNA 2010100O12 gene | Corona_7, SS, TM | 13.8 |
| 412623 | R28898 | Hs. 74170 | metallothionein 1E (functional | SS, TM, metalthio, DEAD, meta | 13.7 |
| 448133 | AA723157 | Hs. 73769 | folate receptor 1 (adult) | Folate_rec, SS | 13.5 |
| 453367 | AW732847 | Hs. 70573 | PKCI-1-related HIT protein | SS, TM | 13.5 |
| 431462 | AW583672 | Hs. 256311 | granin-like neuroendocrine pep | SS | 13.2 |
| 408724 | AI685842 | Hs. 294143 | ESTs, Weakly similar to T22914 | SS, pkinase, tubulin | 13.2 |
| 423464 | NM_016240 | Hs. 128856 | CSR1 protein | Collagen, SS | 13.1 |
| 428539 | AW410063 | Hs. 184877 | solute carrier family 25 (mito | mito_carr, SS, TM, profilin, | 13.0 |
| 436014 | AF281134 | Hs. 283741 | exosome component Rrp46 | RNase_PH, RNase_PH_C, SS, TG | 12.9 |
| 438857 | AI627912 | Hs. 130783 | Forssman synthetase | SS, RA, RasGEF, RasGEFN | 12.8 |
| 444410 | BE387360 | Hs. 33719 | ESTs, Moderately similar to S6 | SS | 12.8 |
| 427527 | AI809057 | Hs. 153261 | immunoglobulin heavy constant | SS, TM, ig | 12.6 |
| 430168 | AW968343 | | DKFZP43411735 protein | SS, TM, efhand, efhand | 12.5 |
| 437543 | H16443 | Hs. 7117 | glutamate receptor, ionotropic | SS, TM, lig_chan, ANF_recept | 12.4 |
| 413711 | AW291765 | Hs. 75486 | heat shock transcription facto | NA, SS, E2F_TDP | 12.3 |
| 422625 | AW504698 | Hs. 155976 | cullin 4B | SS, SS, Cullin, Cullin | 12.2 |
| 443136 | NM_001440 | Hs. 9018 | exostoses (multiple)-like 3 | Exostosin, SS, TM | 12.1 |
| 407143 | C14076 | Hs. 332329 | EST | SS, TM | 12.1 |
| 424707 | BE061914 | Hs. 10844 | Homo sapiens cDNA FLJ14476 fis | SS, SS, TM, Sema | 12.1 |
| 425251 | Z22521 | Hs. 155342 | protein kinase C, delta | pkinase, DAG_PE-bind, pkina | 12.0 |
| 427336 | NM_005658 | Hs. 2134 | TNF receptor-associated factor | MATH, SS, MATH, A2MN, A2M_N, A2M, NT | 12.0 |
| 421572 | AA531607 | | hypothetical protein FLJ22678 | SS, TM, TGF-beta, ASC | 12.0 |
| 447946 | AI566164 | Hs. 165827 | ESTs | SS, PTN_MK, 7tm_1, DAGKc, DAG | 11.9 |
| 425954 | AK000633 | Hs. 164476 | hypothetical protein FLJ20626 | SCAN, zf-C2H2, KRAB, SS, KRAB | 11.7 |
| 427273 | AW139032 | Hs. 107376 | hypothetical protein DKFZp434N | SS, SS, TM | 11.7 |
| 427397 | AI929685 | Hs. 177656 | calmodulin 1 (phosphorylase ki | efhand, RrnaAD, SS, efhand | 11.7 |
| 424415 | NM_001975 | Hs. 146580 | enolase 2, (gamma, neuronal) | enolase, SS, Atrophin-1, Atr | 11.7 |
| 417852 | AJ250562 | Hs. 82749 | transmembrane 4 superfamily me | transmembrane4, SS, TM | 11.6 |
| 447451 | AI379925 | Hs. 207525 | ESTs | SS, pkinase, PH, pkinase_C | 11.5 |
| 410397 | AF217517 | Hs. 63042 | DKFZp564J157 protein | SS, homeobox, UPF0160, DUF23 | 11.4 |
| 430354 | AA954810 | Hs. 239784 | human homolog of Drosophila Sc | SS, TM, ig | 11.3 |
| 419390 | AI701162 | Hs. 90207 | hypothetical protein MGC11138 | SS, TM, PMP22_Claudin, PMP22 | 11.3 |
| 422682 | W05238 | Hs. 94316 | ESTs, Weakly similar to T31613 | SS, TM, DEAD, helicase_C, Lam | 11.3 |
| 422178 | AL122083 | Hs. 112645 | Homo sapiens mRNA; cDNA DKFZp4 | SS, TM | 11.2 |
| 450122 | BE313765 | Hs. 343443 | ESTs, Weakly similar to I38022 | SS, TM, Y_phosphatase, LON, A | 11.1 |
| 453968 | AA847645 | Hs. 62711 | High mobility group (nonhiston | SS, HMG_box | 11.1 |
| 444744 | BE394732 | Hs. 147562 | ESTs | SS | 10.9 |
| 423220 | BE394920 | Hs. 125262 | aladin | WD40, TM, Activin_recp, pkin | 10.9 |
| 417116 | Z43916 | Hs. 7634 | hypothetical protein FLJ12287 | SS, TM, filament, IF_tail | 10.9 |
| 406779 | AA412048 | Hs. 279574 | CGI-39 protein, cell death-reg | SS, SS | 10.8 |
| 450593 | AF129085 | Hs. 25197 | STIP1 homology and U-Box conta | TPR, SS, TM, Rhomboid, lactam | 10.7 |
| 406837 | R70292 | Hs. 156110 | immunoglobulin kappa constant | SS | 10.7 |
| 452434 | D30934 | Hs. 29549 | C-type lectin-like receptor-1 | lectin_c, SS, TM | 10.7 |
| 440150 | AW975738 | Hs. 7001 | Homo sapiens, clone IMAGE 3940 | SS, TM, SS, TM, Peptidase_M22 | 10.6 |
| 418641 | BE243136 | Hs. 86947 | a disintegrin and metalloprote | disintegrin, Reprolysin, Pe | 10.6 |
| 414313 | NM_004371 | Hs. 75887 | coatomer protein complex, subu | WD4O, SS, WD40, Ribosomal_S2 | 10.6 |
| 420307 | AW502869 | Hs. 66219 | ESTs | SS, TM | 10.6 |
| 414918 | AI219207 | Hs. 72222 | hypothetical protein FLJ13459 | SS, TM, efhand | 10.6 |
| 446562 | BE272686 | Hs. 15356 | hypothetical protein FLJ20254 | hormone, SS, pfkB | 10.5 |
| 419846 | NM_015977 | Hs. 285681 | Williams-Beuren syndrome chrom | SS, HLH, SS, TM, WD4O | 10.4 |
| 453023 | AW028733 | Hs. 31439 | serine protease inhibitor, Kun | Kunitz BPTI, SS, TM, ion_tra | 10.4 |
| 438800 | AB037108 | Hs. 6418 | seven transmembrane domain orp | SS, TM | 10.3 |
| 431275 | T56571 | Hs. 10041 | ESTs | SS, HLH | 10.3 |
| 407241 | M34516 | | gb: Human omega light chain pro | SS, ig, PH, ig, PH | 10.3 |
| 441238 | AI372555 | Hs. 322456 | hypothetical protein DKFZp761D | homeobox, SS, TM, Rho_GDI, th | 10.3 |
| 436325 | AL390088 | Hs. 7393 | hypothetical protein from EURO | SS, Synapsin_C, SS | 10.3 |
| 435605 | AF151815 | Hs. 4973 | hypothetical protein | SS, TM, SS, TM, ABC_tran, ABC- | 10.3 |
| 444202 | AL031685 | Hs. 12785 | KIAA0939 protein | SS, TM, Na_H_Exchanger, ABC2 | 10.3 |
| 425597 | U28694 | Hs. 158324 | chemokine (C-C motif) receptor | 7tm_N | 10.3 |
| 415200 | AL040328 | Hs. 78202 | SWI/SNF related, matrix associ | SNF2_N, helicase_C, bromodo | 10.2 |
| 446528 | AU076640 | Hs. 15243 | nucleolar protein 1 (120 kD) | Nol1_Nop2_Sun, SS, SNF2_N, h | 10.2 |
| 414874 | D26351 | Hs. 77515 | inositol 1,4,5-triphosphate re | TM, RYDR_ITPR, ion_trans, MI | 10.2 |
| 423524 | AF055989 | Hs. 129738 | potassium voltage-gated channe | ion_trans, K_tetra, thaumat | 10.2 |
| 434652 | AA639618 | Hs. 325116 | Homo sapiens, clone MGC: 2962, | SS | 10.2 |
| 406836 | AW514501 | Hs. 156110 | immunoglobulin kappa constant | SS | 10.1 |
| 420233 | AA256714 | Hs. 194864 | hypothetical protein FLJ22578 | SS | 10.1 |
| 427458 | BE208364 | Hs. 29283 | ESTs, Weakly similar to LKHU p | SS, F5_F8_type_C, EGF, TGT | 10.1 |
| 427672 | AA356615 | Hs. 336916 | death-associated protein 6 | SS, BTB, abhydrolase_2, RasG | 10.0 |
| 423218 | NM_015896 | Hs. 167380 | BLu protein | zf-MYND, SS, TM, Glyco_hydro | 10.0 |

TABLE 15A-continued

| Pkey | ExAccn | UniGene ID | Unigene Title | Pred Protein Dom | R1 |
|---|---|---|---|---|---|
| 403028 | | | Target Exon | SS, trefoil | 10.0 |
| 412790 | NM_014767 | Hs. 74583 | KIAA0275 gene product | kazal, thyroglobulin_1, zf- | 10.0 |
| 419823 | AW271708 | Hs. 118918 | ESTs, Weakly similar to M2OM_H | SS, TM | 10.0 |
| 433886 | AA613596 | Hs. 28412 | ESTs | SS | 9.9 |
| 428092 | AW879141 | | ESTs | SS, TM | 9.8 |
| 450493 | M93718 | Hs. 166373 | nitric oxide synthase 3 (endot | flavodoxin, FAD_binding, NO | 9.7 |
| 420423 | AA827718 | Hs. 88218 | ESTs | SS | 9.7 |
| 452302 | AF173867 | Hs. 28906 | glucocorticoid modulatory elem | SAND, SS | 9.7 |
| 444681 | AJ243937 | Hs. 288316 | chromosome 6 open reading fram | notch, EGF, ank, GoLoco, SS, T | 9.7 |
| 414249 | AI797994 | Hs. 279929 | gp25L2 protein | SS, TM, EMP24_GP25L, SS, TM, G | 9.6 |
| 424263 | M77640 | Hs. 1757 | L1 cell adhesion molecule (hyd | fn3, ig, IRK, SS, TM, fn3, ig, R | 9.6 |
| 438627 | AI087335 | Hs. 123473 | ESTs | TM, Reticulon | 9.6 |
| 407065 | Y10141 | | gb: H. sapiens DAT1 gene, partia | SNF, SS, TM | 9.6 |
| 441307 | AW071696 | Hs. 209065 | hypothetical protein FLJ14225 | SS, TM | 9.6 |
| 409649 | AA159216 | Hs. 55505 | hypothetical protein FLJ20442 | Y_phosphatase, DSPc, TM | 9.6 |
| 424487 | T08754 | Hs. 6259 | KIAA1698 protein | SS, SS, TM, Glyco_hydro_31, G | 9.5 |
| 444633 | AF111713 | Hs. 286218 | junctional adhesion molecule 1 | ig, SS, TM, HLH | 9.4 |
| 427747 | AW411425 | Hs. 180655 | serine/threonine kinase 12 | pkinase, SS, TM, synaptobrev | 9.4 |
| 450437 | X13956 | Hs. 24998 | hypothetical protein MGC10471 | SS | 9.4 |
| 415169 | W42913 | Hs. 78089 | ATPase, vacuolar, 14 kD | ATP-synt_F, SS, TM, CH, Filam | 9.4 |
| 400201 | | | NM_006156*. Homo sapiens neural | ubiquitin, SS, TM, Transglut | 9.4 |
| 454319 | AW247736 | Hs. 101617 | ESTs, Weakly similar to T32527 | SS | 9.4 |
| 421680 | AL031186 | Hs. 289106 | Human DNA sequence from clone | SS, SS, rrm, zf-RanBP, rrm, GA | 9.4 |
| 445143 | U29171 | Hs. 75852 | casein kinase 1, delta | pkinase, SS | 9.4 |
| 407507 | U73799 | | gb: Human dynactin mRNA, partia | SS, TM, HCO3_cotransp, CAP_G | 9.4 |
| 450883 | NM_001348 | Hs. 25619 | death-associated protein kinas | pkinase, GTP_EFTU, EFG_C, GT | 9.4 |
| 411674 | AW861123 | | gb: RC3-CT0297-120200-014-a05 C | SS | 9.3 |
| 414625 | AA335738 | Hs. 76686 | glutathione peroxidase 1 | GSHPx, SS, ras, HLH | 9.3 |
| 456950 | AF111170 | Hs. 306165 | Homo sapiens 14q32 Jagged2 gen | SS, TM, DSL | 9.3 |
| 445333 | BE537641 | Hs. 44278 | hypothetical protein FLJ12538 | SS | 9.2 |
| 407204 | R41933 | Hs. 140217 | ESTs, Weakly similar to ALU1_H | SS, histone, histone | 9.1 |
| 412338 | AA151527 | Hs. 69485 | hypothetical protein FLJ12436 | SS, TM, TIG, Sema, PSI | 9.1 |
| 439963 | AW247529 | Hs. 6793 | platelet-activating factor ace | PAF-AH_Ib, Lipase_GDSL, SS, | 9.1 |
| 412104 | AW205197 | Hs. 240951 | Homo sapiens, Similar to RIKEN | SS, TM | 9.1 |
| 443553 | AL040535 | Hs. 9573 | ATP-binding cassette, sub-fami | ABC_tran, SS | 9.1 |
| 448984 | AW751955 | Hs. 22753 | hypothetical protein FLJ22318 | SS | 9.0 |
| 418776 | AI401004 | Hs. 88411 | lymphocyte antigen 117 | SS, TNF, TNF | 9.0 |
| 418843 | AJ251016 | Hs. 89230 | potassium intermediate/small c | TM, CaMBD, SK_channel, TM | 9.0 |
| 419244 | AI436567 | Hs. 89761 | ATP synthase, H transporting, | ATP-synt_DE, SS, rrm, Ephrin | 8.9 |
| 451855 | R54913 | Hs. 175804 | ESTs | SS, TM, vwa | 8.9 |
| 424825 | AF207069 | Hs. 153357 | procollagen-lysine, 2-oxogluta | 2OG-FeII_Oxy, Glycos_trans | 8.9 |
| 447374 | AF263462 | Hs. 18376 | KIAA1319 protein | SS, Myosin_tail, M | 8.9 |
| 430167 | Y08976 | Hs. 234759 | FEV protein | Ets, SS, crystall | 8.8 |
| 409936 | AK001691 | Hs. 57655 | hypothetical protein FLJ10829 | SS, TM | 8.7 |
| 437926 | BE383605 | Hs. 300816 | small GTP-binding protein | SS, TM, TPR | 8.7 |
| 430037 | BE409649 | Hs. 227789 | mitogen-activated protein kina | pkinase | 8.7 |
| 424919 | BE314461 | Hs. 153768 | U3 snoRNP-associated 55-kDa pr | WD40, SS, KH-domain | 8.7 |
| 414534 | BE257293 | Hs. 76366 | BCL2-antagonist of cell death | SS, hormone_rec, zf-C4 | 8.7 |
| 433333 | AI016521 | Hs. 71816 | v-akt murine thymoma viral onc | homeobox, pkinase, PH, pkina | 8.7 |
| 423228 | AL137491 | Hs. 125511 | Homo sapiens mRNA, cDNA DKFZp4 | SS, TM, sushi | 8.7 |
| 419493 | AF001212 | Hs. 90744 | proteasome (prosome, macropain | PCI, SS, CDK5_activator | 8.7 |
| 420160 | AI492840 | | ESTs | SS, TM | 8.6 |
| 421871 | AK001416 | Hs. 306122 | glycoprotein, synaptic 2 | TM, Steroid_dh, SS | 8.6 |
| 447827 | U73727 | Hs. 19718 | protein tyrosine phosphatase, | Y_phosphatase, fn3, ig, MAM, | 8.6 |
| 417193 | AI922189 | Hs. 288390 | hypothetical protein FLJ22795 | SS | 8.6 |
| 418676 | NM_001327 | Hs. 167379 | cancer/testis antigen (NY-ESO- | SS, TM, zf-C2H2 | 8.5 |
| 458963 | AI701393 | Hs. 278728 | Rad and Gem-related 2 (rat hom | ras, SS, Peptidase_M10, hemo | 8.5 |
| 406868 | AA505445 | Hs. 300697 | immunoglobulin heavy constant | SS, TM, ig | 8.3 |
| 434105 | AW952124 | Hs. 13094 | presenilins associated rhomboi | TM, Rhomboid, SS, TM | 8.3 |
| 421726 | AK001237 | Hs. 319088 | hypothetical protein FLJ10375 | TM | 8.3 |
| 421707 | NM_014921 | Hs. 107054 | lectomedin-2 | Latrophilin, OLF, 7tm_2, Gal | 8.2 |
| 453898 | AW003512 | Hs. 232770 | arachidonate lipoxygenase 3 | SS, TM, lipoxygenase, PLAT, s | 8.2 |
| 456672 | AK002016 | Hs. 114727 | Homo sapiens, clone MGC: 16327, | SS, PK, PK_C, myosin_head, Rh | 8.2 |
| 421592 | AF009801 | Hs. 105941 | bagpipe homeobox (Drosophila) | homeobox, SS | 8.2 |
| 409829 | M33552 | Hs. 56729 | lymphocyte-specific protein 1 | Caldesmon, SS, Ribosomal_S2 | 8.1 |
| 444341 | AI142027 | Hs. 146650 | ESTs | SS, TM, Reprolysin, Pep_M12B | 8.0 |
| 413762 | AW411479 | Hs. 848 | FK506-binding protein 4 (59 kD) | FKBP, TPR, SS | 8.0 |
| 436685 | W28661 | Hs. 5288 | Homo sapiens mRNA, cDNA DKFZp4 | SS, TM, pkinase, Activin_rec | 8.0 |
| 420932 | AW374605 | Hs. 11607 | ESTs, Weakly similar to T21697 | SS, bZIP_Maf | 8.0 |
| 431493 | AI791493 | Hs. 129873 | ESTs, novel cytochrome P450 | SS, p450, SS | 7.9 |
| 447598 | AI799968 | Hs. 199630 | ESTs | SS, TM | 7.9 |
| 415758 | BE270465 | Hs. 78793 | protein kinase C, zeta | pkinase, DAG_PE-bind, pkina | 7.8 |
| 457022 | AW377258 | | gb: MR2-CT0222-261099-003-a10 C | SS, Ribosomal_L7Ae | 7.8 |
| 426440 | BE382756 | Hs. 169902 | solute carrier family 2 (facil | sugar_tr, SS, TM, sugar_tr | 7.8 |
| 432747 | NM_014404 | Hs. 278907 | calcium channel, voltage-depen | PMP22_Claudin, SS, TM, PMP22 | 7.8 |
| 441084 | W24563 | Hs. 9911 | hypothetical protein FLJ11773 | SS, TM, hormone_rec, zf-C4 | 7.8 |
| 424443 | AI751281 | Hs. 284161 | hypothetical protein from EURO | SS, TM, SS, TM | 7.7 |

TABLE 15A-continued

| Pkey | ExAccn | UniGene ID | Unigene Title | Pred Protein Dom | R1 |
|---|---|---|---|---|---|
| 424198 | AB029010 | Hs. 143026 | KIAA1087 protein | SS, TM, Na_Ca_Ex, Calx-beta, | 7.6 |
| 430513 | AJ012008 | Hs. 241586 | G6C protein | SS, TM, GST_C, abhydrotase | 7.6 |
| 417900 | BE250127 | Hs. 82906 | CDC20 (cell division cycle 20, | WD4O, SS, TM, fn3, EGF, fn3, ig | 7.6 |
| 432891 | AF161483 | Hs. 279761 | HSPC134 protein | SS, TM, ubiquitin, Transglut | 7.5 |
| 432234 | AA531128 | Hs. 115803 | ESTs | SS | 7.5 |
| 453485 | BE620712 | Hs. 33026 | hypothetical protein PP2447 | SS, TM | 7.5 |
| 441327 | AK001706 | Hs. 7778 | hypothetical protein FLJ10751 | SS, TM, 7tm_1 | 7.5 |
| 436540 | BE397032 | Hs. 14468 | hypothetical protein MGC14226 | SS, TM | 7.5 |
| 418256 | AW845318 | Hs. 12271 | f-box and leucine-rich repeat | SS, SS, TM, HSF_DNA-bind | 7.5 |
| 457274 | AW674193 | Hs. 227152 | mannan-binding lectin serine p | SS, TM, SS, TM, Clathrin_lg_c | 7.5 |
| 437141 | BE304917 | Hs. 31097 | hypothetical protein FLJ21478 | SS, TM, Glycos_transf_4 | 7.5 |
| 425428 | AL110261 | Hs. 157211 | DKFZP586B0621 protein | C1q, Collagen, SS | 7.4 |
| 431934 | AB031481 | Hs. 272214 | STG protein | SS | 7.4 |
| 418349 | NM_001383 | Hs. 84183 | diptheria toxin resistance pro | Diphthamide_syn, SS | 7.4 |
| 430600 | AW950967 | Hs. 274348 | HLA-B associated transcript-3 | ubiquitin, SS, TM, G-patch, a | 7.3 |
| 421758 | BE397336 | Hs. 1422 | Gardner-Rasheed feline sarcoma | SH2, SH3, pkinase | 7.3 |
| 412841 | AI751157 | Hs. 101395 | hypothetical protein MGC11352 | SS, TM | 7.3 |
| 418313 | BE244231 | Hs. 84038 | CGI-06 protein | SS, wap | 7.3 |
| 429367 | AB007867 | Hs. 278311 | plexin B1 | Sema, PSI, TIG, SS, TM, TIG, Se | 7.3 |
| 418837 | U48263 | Hs. 89040 | prepronociceptin | Opiods_nenropep, SS | 7.2 |
| 423015 | U18548 | Hs. 123034 | G protein-coupled receptor 12 | TM | 7.2 |
| 440188 | AK001812 | Hs. 7036 | N-Acetylglucosamine kinase | ROK, SS, TM | 7.2 |
| 421975 | AW961017 | Hs. 6459 | hypothetical protein FLJ11856 | SS, TM, ACAT | 7.2 |
| 423858 | AL137326 | Hs. 133483 | *Homo sapiens* mRNA; cDNA DKFZp4 | SS, TM | 7.2 |
| 446143 | BE245342 | Hs. 306079 | sec61 homolog | secY, SS, TM | 7.2 |
| 417704 | NM_001747 | Hs. 82422 | capping protein (actin filamen | Gelsolin, SS, Gelsolin | 7.2 |
| 440869 | NM_014297 | Hs. 7486 | protein expressed in thyroid | lactamase_B, SS, XRCC1_N, BR | 7.1 |
| 435099 | AC004770 | Hs. 4756 | flap structure-specific endonu | XPG_N, XPG_I, 5_3_exonuclea | 7.1 |
| 438856 | N40027 | Hs. 7473 | ESTs | SS, TM, connexin | 7.1 |
| 426268 | AF083420 | Hs. 168913 | serine/threonine kinase 24 (St | pkinase, pkinase | 7.1 |
| 418373 | AW750770 | Hs. 84344 | CGI-135 protein | SS, TM, PMP22_Claudin, 2OG-F | 7.1 |
| 445087 | AW893449 | Hs. 12303 | suppressor of Ty (*S.cerevisiae* | S1, SH2, Ribosomal_L23, pkin | 7.1 |
| 421748 | NM_014718 | Hs. 107809 | KIAA0726 gene product | cadherin, TM, TPR | 7.1 |
| 413837 | AW163525 | | titin-cap (telethonin) | SS, Methyltransf_3 | 7.0 |
| 426691 | NM_006201 | Hs. 171834 | PCTAIRE protein kinase 1 | pkinase, SS, UCH-2, UCH-1, rr | 7.0 |
| 409125 | R17268 | Hs. 343567 | axonal transport of synaptic v | SS, kinesin, PH, FHA, kinesin | 7.0 |
| 424251 | AA677466 | Hs. 143696 | coactivator-associated arginin | SS, SNF2_N, helicase_C, brom | 7.0 |
| 431630 | NM_002204 | Hs. 265829 | integrin, alpha 3 (antigen CD4 | integrin_A, FG-GAP, Rhabd_g | 7.0 |
| 428156 | BE269388 | Hs. 182698 | mitochondrial ribosomal protein | SS | 7.0 |
| 459255 | AI493244 | Hs. 239500 | hypothetical protein MGC13114 | SS | 7.0 |
| 441323 | AA928413 | Hs. 159089 | ESTs, Weakly similar to ALU7_H | SS, Peptidase_C1, zf-C2H2 | 6.9 |
| 455928 | BE170313 | | gb: QV4-HT0536-040500-193-g02 H | SS | 6.9 |
| 420856 | BE513294 | Hs. 205736 | HLA class II region expressed | kazal, SS, TM, ig, pkinase | 6.9 |
| 421543 | AK000519 | Hs. 105606 | hypothetical protein FLJ20512 | TM | 6.9 |
| 442296 | NM_007275 | Hs. 8186 | lung cancer candidate | SS, TM, Glyco_hydro_56, Glyc | 6.9 |
| 445937 | AI452943 | Hs. 321231 | UDP-Gal betaGlcNAc beta 1, 4-g | Galactosyl_T_2, SS, TM, tsp_ | 6.9 |
| 439732 | AW629604 | Hs. 167641 | hypothetical protein from EURO | SS, TM, SS, TM, A2M, A2M_N, NTR | 6.8 |
| 429542 | AF038660 | Hs. 206713 | UDP-Gal betaGlcNAc beta 1, 4-g | Galactosyl_T_2, ig, SS, TM, A | 6.8 |
| 420190 | AI816209 | Hs. 95867 | hypothetical protein EST00098 | SS, dynamin_2, dynamin, PH, G | 6.8 |
| 408215 | BE614290 | | syntaxin 10 | SS, SS, TM, HLH, TRM, zf-CCCH | 6.7 |
| 410277 | R88621 | Hs. 26249 | ESTs, Weakly similar to T2D3_H | SS, TM, SS | 6.7 |
| 419667 | AU077005 | Hs. 92208 | a disintegrin and metalloprote | disintegrin, Reprolysin, Pe | 6.7 |
| 448677 | AI560769 | | ESTs | SS, TM | 6.7 |
| 425228 | NM_005253 | Hs. 301612 | FOS-like antigen 2 | bZIP, SS | 6.6 |
| 432538 | BE258332 | Hs. 278362 | male-enhanced antigen | SS, TM, AAA, Ribosomal_L2 | 6.6 |
| 421864 | BE387198 | Hs. 108973 | dolichyl-phosphate mannosyltra | SS, TM, SS, TM | 6.6 |
| 429962 | M69113 | Hs. 226795 | glutathione S-transferase pi | GST_C, GST_N, SS, efhand | 6.6 |
| 406867 | AA157857 | Hs. 182265 | keratin 19 | filament, bZIP, SS, filament | 6.6 |
| 426068 | AF029778 | Hs. 166154 | jagged 2 | DSL, EGF, vwc, granulin, SS, T | 6.5 |
| 419344 | U94905 | Hs. 277445 | diacylglycerol kinase, zeta (1 | ank, DAGKa, DAGKc, DAG_PE-bi | 6.5 |
| 424681 | AA054400 | Hs. 151706 | KIAA0134 gene product | helicase_C, PRK, SS, TM, 7tm_ | 6.5 |
| 417903 | NM_002342 | Hs. 1116 | lymphotoxin beta receptor (TNF | TNFR_c6, SS | 6.5 |
| 423876 | BE502835 | Hs. 15463 | *Homo sapiens*, clone IMAGE 2959 | SS, efhand | 6.4 |
| 433439 | AA431176 | Hs. 133230 | ribosomal protein S15 | TM, SS, TM, TPR, ras | 6.4 |
| 441379 | AW175787 | Hs. 334841 | selenium binding protein 1 | SS, RFX_DNA_binding | 6.4 |
| 432968 | BE614192 | Hs. 279869 | melanoma-associated antigen re | SS, TM, RGS, DIX | 6.4 |
| 456863 | T16837 | Hs. 4241 | ESTs | fusion_gly, homeobox, TM | 6.4 |
| 432269 | NM_002447 | Hs. 2942 | macrophage stimulating 1 recep | pkinase, Sema, PSI, TIG, A4_E | 6.4 |
| 425676 | AW410656 | Hs. 159161 | Rho GDP dissociation inhibitor | Rho_GDI, homeobox, SS, Cytid | 6.4 |
| 443420 | R06846 | Hs. 191208 | ESTs | SS | 6.4 |
| 436322 | AL355092 | Hs. 120243 | parvin, gamma | CH, SS, TM, CTF_NFI | 6.4 |
| 440088 | BE559877 | Hs. 183232 | hypothetical protein FLJ22638 | SS, zf-C3HC4, SPRY, zf-B_box | 6.4 |
| 447665 | BE044245 | Hs. 30011 | hypothetical protein MGC2963 | SS, TM | 6.3 |
| 431785 | AA292385 | Hs. 268763 | Breakpoint cluster region prot | BAF, kazal, TM | 6.3 |
| 422714 | AB018335 | Hs. 119387 | KIAA0792 gene product | DUF221, SS, TM, TGFb_propept | 6.3 |
| 434916 | AF161383 | Hs. 284207 | *Homo sapiens*, Similar to RIKEN | TM | 6.3 |
| 414551 | AI815639 | Hs. 76394 | enoyl Coenzyme A hydratase, sh | ECH, Peptidase_U7, SS, TM | 6.3 |

TABLE 15A-continued

| Pkey | ExAccn | UniGene ID | Unigene Title | Pred Protein Dom | R1 |
|---|---|---|---|---|---|
| 413254 | U40272 | Hs. 75253 | isocitrate dehydrogenase 3 (NA | isodh, SS | 6.3 |
| 458367 | AA088470 | Hs. 83135 | *Homo sapiens*, Similar to RIKEN | SS, tRNA-synt_2d | 6.3 |
| 415010 | NM_004203 | Hs. 77783 | membrane-associated tyrosine- | pkinase, SS, PMP22_Claudin | 6.3 |
| 410076 | T05387 | Hs. 7991 | ESTs | SS | 6.3 |
| 412940 | BE295701 | Hs. 819 | homeo box B7 | homeobox, SS, homeobox, home | 6.2 |
| 440042 | AI073387 | Hs. 133898 | ESTs | SS | 6.2 |
| 414023 | BE243628 | | gb: TCBAP1D1053 Pediatric pre-B | SS | 6.2 |
| 414513 | AW239400 | Hs. 76297 | G protein-coupled receptor kin | pkinase, RGS, pkinase_C, SS, | 6.2 |
| 446662 | NM_013323 | Hs. 15827 | sorting nexin 11 | PX, SS | 6.2 |
| 409882 | AJ243191 | Hs. 56874 | heat shock 27kD protein family | HSP2O, SS, TMzf-C2H2, BTB, E | 6.2 |
| 414576 | AK000405 | Hs. 76480 | ubiquitin-like 4 | ubiquitin, SS, TM, G6PD, G6PD | 6.2 |
| 447507 | H59696 | Hs. 18747 | POP7 (processing of precursor, | SS, TM, WD40, vwd, MAM, EPO_TP | 6.2 |
| 453447 | AW771318 | Hs. 326586 | hypothencal protein MGC11134 | SS, TPR | 6.1 |
| 435968 | AW161481 | Hs. 111577 | integral membrane protein 3 | TM | 6.1 |
| 424441 | X14850 | Hs. 147097 | H2A histonefamily, member X | histone, CRED_NFYB_HMF, SS, | 6.1 |
| 434558 | AW264102 | Hs. 39168 | ESTs | SS, TM, LRRCT, LRR | 6.1 |
| 434202 | BE382411 | Hs. 3764 | guanytate kinase 1 | Guanylate_kin, CoaE, Viral_ | 6.1 |
| 432183 | AW151952 | Hs. 46679 | hypothetical protein FLJ20739 | SS | 6.0 |
| 444416 | AW288085 | Hs. 11156 | hypothetical protein | zf-C3HC4, SpoA, PHD, TM, syna | 6.0 |
| 447205 | BE617015 | Hs. 11006 | ESTs, Moderately similar to T1 | SS, TM, LRRCT, Sema | 6.0 |
| 407704 | BE315072 | Hs. 78768 | malignant cell expression-enha | TM, MBOAT, SS, TM | 6.0 |
| 453190 | AB002354 | Hs. 32312 | KIAA0356 gene product | PH, PHD, RUN, SS | 6.0 |
| 439975 | AW328081 | Hs. 6817 | inosine triphosphatase (nucleo | Ham 1p_like, SS | 6.0 |
| 449514 | AW970440 | Hs. 23642 | protein predicted by clone 236 | SS, PX, arf, lipocalin, PHD, z | 6.0 |
| 432805 | X94630 | Hs. 3107 | CD97 antigen | SS, TM, 7tm_2, GPS, EGF, SS, TM | 6.0 |
| 414362 | AI347934 | Hs. 75932 | N-ethylmaleimide-sensitive fac | NSF, SS, TM | 6.0 |
| 417483 | BE549343 | Hs. 82208 | acyl-Coenzyme A dehydrogenase, | Acyl-CoA_dh, Acyl-Cokdh_M | 6.0 |
| 427988 | A44789333 | Hs. 181349 | hypothetical protein 628 | SS, SS | 6.0 |
| 423473 | H49104 | Hs. 129888 | hypothetical protein FLJ14768 | zf-C2H2, SS, mm, ENTH | 6.0 |
| 406773 | AA812424 | Hs. 76067 | heat shock 27kD protein 1 | HSP20, SS | 5.9 |
| 409938 | AW974648 | | gb: EST386752 MAGE resequences, | SS, Adapcomp_sub, GYF | 5.9 |
| 424959 | NM_005781 | Hs. 153937 | activated p21cdc42Hs. kinase | pkinase, SH3 | 5.9 |
| 453082 | H18835 | Hs. 31608 | hypothetical protein FLJ20041 | SS, TM, ion_trans | 5.9 |
| 452094 | AF049105 | Hs. 27910 | centrosomal protein 2 | bZIP, 5_3_exonuclease, M, SS | 5.9 |
| 451524 | AK001466 | Hs. 26516 | hypothetical protein FLJ10604 | SS, SS, TM, pkinase, pkinase_ | 5.9 |
| 427438 | AW328515 | Hs. 178011 | hypothetical protein FLJ20257 | SS, TM | 5.9 |
| 439685 | AW956781 | Hs. 293937 | ESTs, Weakly similar to FXD2_H | SS, PWWP, TSC22 | 5.9 |
| 440511 | AF132959 | Hs. 7236 | eNOS interacting protein | SS, TM, MAGE, Ribosomal_S17, | 5.9 |
| 417334 | AA337572 | Hs. 157240 | hypothetical protein MGC4737 | SS, TM, ion_trans | 5.9 |
| 425976 | C75094 | Hs. 334514 | NG22 protein | SS, TM, pkinase, SH2, SH3, BNR | 5.8 |
| 433173 | Z35093 | Hs. 3196 | surfeit 1 | SURF1, SS, TM, SURF1, SURF4 | 5.8 |
| 437891 | AW006969 | Hs. 6311 | hypothetical protein FUJ20859 | TM, SET | 5.8 |
| 410239 | AI568350 | Hs. 61273 | hypothetical protein MGC2650 | SS, ART, TM | 5.8 |
| 458060 | R95860 | Hs. 293629 | hypothetical protein MGC3121 | SS | 5.8 |
| 409591 | AA532963 | Hs. 9100 | *Homo sapiens* cDNA FLJ3100 fis | SS, TM, LIM, homeobox | 5.8 |
| 409686 | AK000002 | Hs. 55879 | *Homo sapiens* mRNA; cDNA DKFZp4 | SS, ABC_tran, SS, TM | 5.8 |
| 450778 | U81375 | Hs. 25450 | solute camer family 29 (nucl | Nucleoside_tran, SS, TM, HSP | 5.8 |
| 423612 | NM_002067 | Hs. 1686 | guanine nucleotide binding pro | G-alpha, arf, SS, G-alpha | 5.8 |
| 422701 | NM_014699 | Hs. 119273 | KIAA0296 gene prodect | zf-C2H2, GST_C, PHD, SS, TM, H | 5.8 |
| 412958 | BE391579 | Hs. 75087 | Fas-activated senne/threonine | SS, pkinase | 5.8 |
| 436957 | AA902488 | Hs. 122952 | ESTs | SS, DAGKc, DAGKa, RA, DAG_PE- | 5.8 |
| 423158 | H97991 | Hs. 193313 | Target CAT | MoaA_NifB_PqqE, SS, TM | 5.8 |
| 414788 | X78342 | Hs. 77313 | cyclin-dependent kinase (CDC2- | pkinase | 5.8 |
| 420904 | AL035964 | Hs. 100221 | nuclear receptor subfamily 1. | hormone_rec, zf-C4, SS, DNA_ | 5.7 |
| 410431 | BE261320 | Hs. 158196 | transcriptional adaptor 3 (ADA | pkinase | 5.7 |
| 420508 | AJ270993 | Hs. 98428 | homeo box B6 | homeobox, SS, homeobox, home | 5.7 |
| 435593 | R88872 | Hs. 4964 | DKFZP586J1624 protein | Herpes_HEPA, SS | 5.7 |
| 433064 | D79991 | Hs. 30002 | SH3-containing protein SH3GLB2 | TM | 5.7 |
| 451920 | AA224483 | Hs. 27239 | DKFZP586K0S24 protein | SS, TM, SS, TM | 5.7 |
| 453054 | AI878908 | Hs. 31547 | Target CAT | SS | 5.7 |
| 415117 | AF120499 | Hs. 78016 | polynecleotide kinase 3-phosp | Viral_helicase1, SS, Amino | 5.7 |
| 413163 | Y00815 | Hs. 75216 | protein tyrosine phosphatase, | fn3, ig, Y_phosphatase, SS, T | 5.7 |
| 425246 | AI085561 | Hs. 155321 | serum response facter (c-fos s | SRF-F, flavodoxin, SS, TM, p | 5.7 |
| 433271 | BE621697 | Hs. 14317 | nucleotar protein family A, me | SS, TM | 5.7 |
| 448484 | BE613340 | Hs. 334725 | Hemo sapiens, Similar to RIKEN | TM, SS, TM, Kunitz_BPTI | 5.7 |
| 449139 | BE268315 | Hs. 23111 | phenylalanine-tRNA synthetase- | neur, SS, zf-C2H2, DNase_II | 5.7 |
| 449181 | X96783 | Hs. 23179 | synaptotagmin V | C2, SS, TM, Y_phosphatase, Tr | 5.6 |
| 414457 | AW514320 | Hs. 76159 | ATPase, H transporting, lysoso | ATP-syn_C, SS, TM, pkinase | 5.6 |
| 424964 | AW161271 | Hs. 153961 | ARP1 (actin-related protein 1, | actin, SS | 5.6 |
| 415193 | AL048891 | Hs. 12185 | hypothetical protein MGC14333 | SS, TM, aminotran_1_2, LRR | 5.6 |
| 407754 | AA527348 | Hs. 288967 | *Homo sapiens* cDNA FLJ14105 fis | SS, TM, SS, TM, TSPN, tsp_3, SE | 5.6 |
| 413049 | N_002151 | Hs. 823 | hepein (transmembrane protease | trypsin, SS, TM, ATP1G1_PLM_ | 5.6 |
| 454252 | H50256 | Hs. 63236 | ribosomal protein S15a | SS | 5.6 |
| 431787 | AW972024 | Hs. 343661 | ret finger protein | SS, WD405, pkinase | 5.6 |
| 431607 | A8033097 | Hs. 183669 | KIAA1271 protein | SS, TM | 5.6 |
| 406782 | AA430373 | | gb: zw20f11 s1 Soares ovary tum | SS | 5.6 |
| 444364 | AL137294 | Hs. 10964 | hypothetical protein FLJ22351 | SS, TM, pkinase | 5.6 |

TABLE 15A-continued

| Pkey | ExAccn | UniGene ID | Unigene Title | Pred Protein Dom | R1 |
|---|---|---|---|---|---|
| 427834 | AA506101 | Hs. 285813 | hypothetical protein FLJ11807 | SS, TM | 5.5 |
| 443759 | BE390832 | Hs. 134729 | FXYD domain-containing ion tra | SS, TM, ATP1G1_PLM_MAT8, ATP | 5.5 |
| 416322 | BE019494 | Hs. 79217 | pyrroline-5-carboxylate redect | P5CR, Octopine_DH_N, SS, thi | 5.5 |
| 406673 | M34996 | Hs. 198253 | major histocompatibility compl | SS, TM, MHC_II_alpha, ig, SS, | 5.5 |
| 415351 | U44755 | Hs. 78403 | small nuclear RNA activating c | SS, TM, pkinase | 5.5 |
| 411030 | BE387193 | Hs. 67896 | 7-60 protein | SS, Collagen, Collagen | 5.5 |
| 410653 | BE383768 | Hs. 65238 | 95 kDa retinoblastoma protein | zf-C3HC4, SS, SNF2_N, helica | 5.5 |
| 433012 | NM_004045 | Hs. 279910 | ATX1 (antioxidant protein 1, y | HMA, SS, TM | 5.5 |
| 437741 | BE561610 | Hs. 5809 | putative transmembrane protein | SS, TM, SS, TM, RA, VPS9, SH2 | 5.5 |
| 421883 | X55079 | Hs. 1437 | glucosidase, alpha; acid (Pomp | trefoil, Glyco_hydro_31, SS | 5.4 |
| 427361 | AW732480 | Hs. 7678 | cellular retinoic acid-binding | SS, TM, aminotran_1_2, LRR | 5.4 |
| 411574 | BE242842 | Hs. 6780 | protein tyrosine kinase 9-like | cofilin_ADF, SS, TM | 5.4 |
| 457313 | AF047002 | Hs. 241520 | transcriptional coactivater | SS, rrm, SS, Cytidylyltransf | 5.4 |
| 428345 | AI242431 | Hs. 118282 | PAP-1 binding protein | SS, TM | 5.4 |
| 434845 | BE267057 | Hs. 325321 | hypothetical protein R32184_1 | SS, TM, CH, calponin, ARID | 5.4 |
| 427162 | AB011133 | Hs. 173864 | KIAA0561 protein | SS, pkinase, PDZ, SS, SH2, Rhs | 5.4 |
| 447402 | H54520 | Hs. 18490 | hypothetical protein FLJ20452 | SS, TM | 5.4 |
| 433676 | AW371389 | Hs. 250173 | hypothetical protein FLJ13158 | SS | 5.4 |
| 424373 | AJ133798 | Hs. 146219 | copine VII | C2, SS | 5.4 |
| 423402 | BE167615 | Hs. 141556 | Homo sapiens cDNA FLJ12976 fis | SS | 5.4 |
| 409983 | D50922 | Hs. 57729 | Kelch like ECH-associated prot | BTB, Kelch, SS, TM | 5.4 |
| 450184 | W31096 | Hs. 237617 | Homo sapiens, clone IMAGE 3447 | SS | 5.3 |
| 431629 | AU077025 | Hs. 265827 | interferon, alpha-inducible pr | pkinase, SH2, SH3 | 5.3 |
| 430413 | AW842182 | Hs. 241392 | small inducible cytokine A5 (R | IL8, SS | 5.3 |
| 440333 | AI378424 | Hs. 288761 | hypothetical protein FLJ21749 | SS, TM, IP_trans, pkinase, pk | 5.3 |
| 424927 | AW973666 | Hs. 153850 | hypothetical protein C321D2 4 | SS, TM | 5.3 |
| 412276 | BE262621 | Hs. 73798 | macrophage migration inhibitor | MIF, SS, TM, MIF, sugar_tr | 5.3 |
| 416181 | AA174126 | Hs. 332163 | ESTs | SS, TM, GalP_UDP_transf, Gal | 5.3 |
| 440609 | AI287585 | Hs. 7301 | G protein pathway suppressor 2 | SS, Acyl-CoA_dh, Acyl-CoA_d | 5.3 |
| 435327 | BE301871 | Hs. 4867 | mannosyl (alpha-1, 3-)-glycopro | SS, HLH, Myc_N_term, Myc-LZ, | 5.2 |
| 421139 | AW953933 | Hs. 301372 | KIAA1552 protein | SS, TM | 5.2 |
| 453449 | W16752 | Hs. 32981 | sema domain, immunoglobulin do | SS, Sema, ig, PSI, SS, TM, G-al | 5.2 |
| 414411 | X54079 | Hs. 76067 | heat shock 27kD protein 1 | HSP20, SS | 5.2 |
| 440906 | AW161556 | Hs. 240170 | hypothetical protein MGC2731 | SS, TM, Funn-like, pkinase, | 5.2 |
| 421899 | AJ011895 | Hs. 109281 | Nef-associated factor 1 | Virus_HS, bZIP, G-gamma, Myo | 5.2 |
| 439473 | AI215529 | Hs. 144787 | ESTs | SS | 5.2 |
| 451585 | AK001171 | Hs. 326422 | hypothetical protein MGC4549 | SS, Metallophos | 5.2 |
| 407191 | AA608751 | | gb: ae56h07 s1 Stratagene lung | SS, Peptidase_C1 | 5.2 |
| 427515 | T79526 | Hs. 179516 | integral type I protein | EMP24_GP25L, SS | 5.2 |
| 405325 | | | C14000786* gi|7023514|dbj|BAA9 | SS | 5.2 |
| 434119 | AF193844 | Hs. 3758 | COP9 complex subunit 7a | SS | 5.1 |
| 413052 | BE249841 | | gb: 600942857F2 NIH_MGC_15 Homo | TM, SS, TM | 5.1 |
| 445109 | AF039916 | Hs. 12330 | ectonucleoside triphosphate di | SS, TM, GDA1_CD39, SS, TM, pho | 5.1 |
| 409323 | H28855 | Hs. 53447 | Homo sapiens mRNA, cDNA DKFZp7 | TPR, SS, TM, pkinase, ig | 5.1 |
| 438707 | L08239 | | amino acid system N transporte | SS, TM, ACAT, MBOAT, SS, TM, TB | 5.1 |
| 442599 | AF078037 | Hs. 324051 | RelA-associated inhibitor | SH3, ank, SS, TM, HHH, ig | 5.1 |
| 420372 | AW960049 | Hs. 293660 | Homo sapiens, clone IMAGE 3535 | SS | 5.1 |
| 436576 | AI458213 | Hs. 77542 | ESTs | SS, TM, 7tm_1, DnaJ | 5.1 |
| 439012 | BE383814 | Hs. 6455 | RuvB (E. coli homolog)-like 2 | AAA, DnaB, UPF0079, SS, Cys_k | 5.1 |
| 418910 | Z25821 | Hs. 89466 | Homo sapiens, Similar to dodec | ECH, SS, TM, aminotran_3, ABC | 5.1 |
| 414849 | AW372721 | Hs. 291623 | ESTs, Weakly similar to unname | TM, pkinase | 5.1 |
| 425743 | BE396495 | Hs. 159428 | BCL2-associated X protein | Bcl-2, SS, ferntin, Bcl-2, e | 5.1 |
| 418231 | AA326895 | Hs. 83848 | triosephosphate isomerase 1 | TIM, SS, TM, zf-UBP, UCH-2, UB | 5.0 |
| 419238 | AW959538 | Hs. 321214 | hypothetical protein DKFZp564D | SS, TM, WH2 | 5.0 |
| 441917 | AI989925 | Hs. 24891 | ESTs, Highly similar to unknow | SS, TM, Ammonium_transp | 5.0 |
| 437617 | AI026701 | Hs. 5716 | KIAA0310 gene product | SS, zf-C3HC4, Peptidase_M16 | 5.0 |
| 412867 | AU076861 | Hs. 74637 | testis enhanced gene transcrip | UPF005, SS, TM | 5.0 |
| 419579 | W49529 | Hs. 296200 | hypothetical protein AF053356_ | MSP_domain, SS, TM, CUB, NTR, | 5.0 |
| 425824 | AI939563 | Hs. 159589 | ESTs, Moderately similar to RE | SS, PHD | 5.0 |
| 439440 | NM_001183 | Hs. 6550 | ATPase, H transporting, lysoso | SS, SS, TM, GDI, Sema, TIG, PSI | 5.0 |
| 436042 | AF284422 | Hs. 119178 | cation-chloride cotransporter- | SS, TM, aa_permeases, SS, TM, | 5.0 |
| 410775 | AB014460 | Hs. 66196 | nth (E. coli endonuclease III)- | HhH-GPD, SS, TM, REJ, PLAT, PK | 5.0 |
| 453350 | AI917771 | Hs. 61790 | hypothetical protein FLJ23338 | SS, SS, TM, EMP70, PA28_alpha | 4.9 |
| 400300 | X03363 | | HER2 receptor tyrosine kinase | pkinase | 4.9 |
| 426811 | BE259228 | Hs. 172609 | nucleobindin 1 | efhand, SS, TM, GFO_IDH_MocA | 4.9 |
| 421179 | U72664 | Hs. 148495 | proteasome (prosome, macropain | UIM, SS, TM, PMP22_Claudin, P | 4.9 |
| 429762 | AI346255 | Hs. 216354 | ring finger protein 5 | SS, zf-C3HC4, Palm_thioest | 4.9 |
| 419250 | AW770185 | | U5 snRNP-specific protein, 116 | SS, TM, 7tm_1, BAH, zf-CXXC, D | 4.9 |
| 426831 | BE296216 | Hs. 172673 | S-adenosylhomocysteine hydrola | AdoHcyase, SS | 4.9 |
| 442103 | AA333367 | Hs. 8088 | similar to S. cerevisiae Sec6p | SS | 4.9 |
| 414820 | AA371931 | Hs. 77422 | proteolipid protein 2 (colonic | SS | 4.9 |
| 426742 | AA454912 | Hs. 169407 | SAC2 (suppressor of actin muta | SS, RasGEF, RA, RasGEFN, horm | 4.9 |
| 423880 | BE278111 | Hs. 134200 | DKFZP564C186 protein | UPF0120, SS, TM | 4.9 |
| 429545 | AI824164 | | lymphocyte antigen 6 complex, | SS, TM | 4.9 |
| 443044 | N28522 | Hs. 8935 | quinolinate phosphoribosyltran | QRPTase, ORPTase_N, SS, TM | 4.9 |
| 417080 | BE392846 | Hs. 1063 | small nuclear ribonucleoprotei | SS, S10_plectin | 4.8 |
| 441455 | AJ271671 | Hs. 7854 | zinc/iron regulated transporte | Zip, SS, TM, Cytidylyltransf | 4.8 |

TABLE 15A-continued

| Pkey | ExAccn | UniGene ID | Unigene Title | Pred Protein Dom | R1 |
|---|---|---|---|---|---|
| 410182 | NM_001983 | Hs. 59544 | excision repair cross-compleme | HHH, SS, SH3, ank | 4.8 |
| 456062 | AI866286 | Hs. 71962 | ESTs, Weakly similar to B36298 | SS | 4.8 |
| 439270 | BE268278 | Hs. 28393 | hypothetical protein MGC2592 | SS, TM, HCO3_cotransp | 4.8 |
| 408985 | BE267317 | Hs. 332040 | hypothetical protein MGC13010 | SS, TM, ACAT, LRR | 4.8 |
| 416976 | BE243985 | Hs. 80680 | major vault protein | Vault, SS, TM, kinesin, zf-C2 | 4.8 |
| 436057 | AJ004832 | Hs. 5038 | neuropathy target esterase | cNMP_binding, SS, TM, cNMP_b | 4.8 |
| 424501 | AI470163 | Hs. 323342 | actin related protein 2/3 comp | SS, HhH-GPD | 4.8 |
| 409214 | AW405967 | Hs. 333388 | *Homo sapiens*, clone IMAGE 3957 | SS, EF1BD, P5CR | 4.8 |
| 432716 | AI762964 | Hs. 205180 | ESTs | SS, TM | 4.8 |
| 414460 | L00727 | Hs. 898 | dystrophia myotonica-protein k | pkinase, SS, WD40 | 4.8 |
| 443329 | BE262943 | Hs. 9234 | hypothetical protein MGC1936 | SS, TM, SS, TM, gpdh, gpdh_C | 4.7 |
| 426120 | AA325243 | Hs. 166887 | copine I | C2, SS, aminotran_5 | 4.7 |
| 405356 | | | ENSP00000247029* SEBOX | SS, TM, hemopexin, Somatomed | 4.7 |
| 437118 | AB037857 | Hs. 300591 | CD9 partner 1 | TM, ig, SS, TM | 4.7 |
| 430609 | AA302921 | Hs. 247362 | dimethylarginine dimethylamino | SS, TM, GST_C, abhydrolase | 4.7 |
| 447131 | NM_004585 | Hs. 17466 | retinoic acid receptor respond | SS, TM, pkinase | 4.7 |
| 428469 | BE549205 | Hs. 184488 | flotillin 2 | Band_7, Flotillin, TM | 4.7 |
| 405189 | | | Target Exon | SS | 4.7 |
| 404256 | | | NM_024018* *Homo sapiens* butyro | SS, TM, SPRY, SPRY, ig | 4.7 |
| 457955 | AI208986 | Hs. 121647 | ESTs | SS, zf-B_box, SPRY, SS, Nol1_ | 4.7 |
| 413201 | BE275378 | Hs. 13972 | hypothetical protein MGC12972 | SS, SH2, RhoGAP, SH3, GILT | 4.7 |
| 431115 | AB015427 | Hs. 250493 | zinc finger protein 219 | zf-C2H2, SS | 4.7 |
| 442414 | BE408758 | Hs. 8297 | nbonuclease 6 precursor | ribonuclease_T2, SS, nbonu | 4.7 |
| 418289 | AW403103 | Hs. 83951 | Hermansky-Pudlak syndrome | SS | 4.6 |
| 436730 | AA045767 | Hs. 5300 | bladder cancer associated prot | SS | 4.6 |
| 444596 | BE560662 | Hs. 11417 | Rab acceptor 1 (prenylated) | SS, TM, tig_chan, ANF_recept | 4.6 |
| 433019 | AI208513 | Hs. 279915 | translocase of inner mitochond | zf-Tim 10_DDP, SS | 4.6 |
| 431522 | AI625859 | Hs. 258609 | protein tyrosine phosphatase, | fn3, Y_phosphatase, SS, TM | 4.6 |
| 400846 | | | sortilin-related receptor, L(D | Idl_recept_a, fn3, Idl_rece | 4.6 |
| 422154 | T79045 | Hs. 168812 | ESTs | SS | 4.6 |
| 420321 | D78761 | Hs. 96657 | hyothetical protein | SS, tsp_1, SS | 4.6 |
| 439921 | AL110209 | Hs. 6770 | LCAT-like lysophospholipase | SS, LACT, SS, TM, aa_permease | 4.6 |
| 427122 | AW057736 | Hs. 323910 | HER2 receptor tyrosine kinase | pkinase, Funn-like, Recep_ | 4.6 |
| 426899 | AL043221 | Hs. 172825 | KIAA1037 protein | WD40, TPR, SS, TM | 4.6 |
| 408116 | AA251393 | Hs. 289052 | *Homo sapiens*, Similar to RIKEN | SS, TM | 4.6 |
| 412974 | R18978 | Hs. 75105 | emopamil-binding protein (ster | SS, TM, SS, TM, TBC, rrm, FtsJ | 4.6 |
| 426510 | AW861225 | Hs. 110613 | BANP homolog, SMAR1 Homolog | TM | 4.6 |
| 414702 | L22005 | Hs. 76932 | cell division cycle 34 | UQ_con, SS, trypsin, ig | 4.6 |
| 408135 | AA317248 | Hs. 42957 | methyltransferase-like 1 | Methyltransf_4, SS, p450, Ge | 4.6 |
| 445637 | W58459 | Hs. 8949 | hypothetical protein MGC4172 | SS | 4.6 |
| 452190 | H26735 | Hs. 91668 | *Homo sapiens* clone PP1498 unkn | SS | 4.6 |
| 409680 | W31092 | Hs. 55847 | mitochondnal ribosomal protei | SS, TM, synaptobrevin | 4.6 |
| 421140 | AA298741 | Hs. 102135 | signal sequence receptor, delt | Herpes_UL3, SS, TM, Sema, pki | 4.6 |
| 413407 | AI356293 | Hs. 75339 | inositol polyphosphate phospha | SH2, SAM, SS, Folate_rec | 4.6 |
| 402463 | | | NM_014624: *Homo sapiens* S 100 ca | efhand, S_100, SS, efhand, S_ | 4.5 |
| 426402 | BE387327 | Hs. 80475 | polymerase (RNA) II (DNA direc | SS, PGAM | 4.5 |
| 406939 | M34515 | | gb: Human omega light chain pro | SS, ig, PH | 4.5 |
| 417891 | W79410 | Hs. 82887 | protein phosphatase 1, regulat | SS, TFIIS | 4.5 |
| 426207 | BE390657 | Hs. 30026 | HSPC182 protein | SS | 4.5 |
| 423664 | NM_004714 | Hs. 130988 | dual-specificity tyrosine-(Y)- | pkinase, SS, Fibnllann, CK | 4.5 |
| 432562 | BE531048 | Hs. 278422 | DKFZP586G1122 protein | zf-C2H2, SS, TM, FG-GAP, inte | 4.5 |
| 427391 | W60675 | | hypothetical protein FLJ10350 | SS, SS | 4.5 |
| 432893 | NM_016154 | Hs. 279771 | *Homo sapiens* clone PP1596 unkn | ras, arf, SS, 2OG-Fell_Oxy, 2 | 4.5 |
| 424954 | NM_000546 | Hs. 1846 | tumor protein p53 (Li-Fraumeni | P53, SS | 4.5 |
| 413815 | AL046341 | Hs. 75562 | discoidin domain receptor fami | F5_F8_type_C, pkinase, SS, T | 4.5 |
| 448963 | AA459796 | Hs. 331247 | *Homo sapiens*, clone IMAGE 3610 | SS, TM | 4.5 |
| 416297 | AA157634 | Hs. 79172 | solute carrier family 25 (mito | mito_carr, SS | 4.5 |
| 421962 | D82061 | Hs. 288354 | FabG (beta-ketoacyl-[acyl-carr | SS, adh_short, SS, TM, zf-C3H | 4.5 |
| 426726 | AA488915 | Hs. 171955 | trophinin associated protein ( | SS | 4.5 |
| 414427 | L19711 | Hs. 76111 | dystroglycan 1 (dystrophin-ass | SS, TM | 4.5 |
| 435891 | AW249394 | Hs. 5002 | copper chaperone for superoxid | sodcu, HMA, SS, TM, spectrin, | 4.5 |
| 453997 | AW247615 | Hs. 37003 | v-Ha-ras Harvey rat sarcoma vi | ras, SS | 4.5 |
| 449029 | N28989 | Hs. 22891 | solute carrier family 7 (catio | aa_permeases, SS, TM, bZIP | 4.5 |
| 432078 | BE314877 | Hs. 24553 | hypothetical protein FLJ12541 | SS, TM | 4.5 |
| 409650 | T08490 | Hs. 288969 | HSCARG protein | SS, SS, WD40 | 4.5 |
| 412833 | AW960547 | Hs. 298262 | ribosomal protein S19 | SS, TM, ig, ITAM, Ribosomal_S | 4.4 |
| 424133 | AA335721 | Hs. 213628 | ESTs | SS, TM | 4.4 |
| 414787 | AL049332 | Hs. 77311 | BTG family, member 3 | SS, Anti_proliferat | 4.4 |
| 433046 | AA229553 | Hs. 279945 | HSPC023 protein | SS | 4.4 |
| 417068 | AA451910 | Hs. 85852 | hypothetical protein MGC3169 | SS, TM | 4.4 |
| 414814 | D14697 | Hs. 77393 | farnesyl diphosphate synthase | polyprenyl_synt, SS, TM | 4.4 |
| 418267 | BE389537 | Hs. 83919 | glucosidase I | Glyco_hydro_63, SS, PH | 4.4 |
| 439902 | AF174499 | Hs. 6764 | hiotone deacetylase 6 | Hist_deacetyl, zf-UBP, SS, G | 4.4 |
| 448847 | AI587180 | Hs. 110906 | *Homo sapiens*, Similar to RIKEN | TM, SS | 4.4 |
| 452160 | BE378541 | | cysteine sulfinic acid decarbo | SS | 4.4 |
| 416121 | X92762 | Hs. 79021 | tafazzin (cardiomyopathy, dila | Acyltransferase, SS, TM, GDI | 4.4 |
| 449717 | AB040935 | Hs. 23954 | cerebral cell adhesion molecut | SS, SS | 4.4 |

TABLE 15A-continued

| Pkey | ExAccn | UniGene ID | Unigene Title | Pred Protein Dom | R1 |
|---|---|---|---|---|---|
| 425069 | AA687465 | Hs. 298184 | potassium voltage-gated channe | SS, aldo_ket_red | 4.4 |
| 413380 | AI904232 | Hs. 75323 | prohibitin | Band_7, SS, Band_7, SH3 | 4.4 |
| 452911 | AA541537 | Hs. 112619 | metallothionein 1E (functional | SS, SS, TM, Sec1 | 4.4 |
| 436415 | BE265254 | Hs. 343258 | proliferation-associated 2G4, | Peptidase_M24, SS, TM, Pepti | 4.4 |
| 429218 | AA225065 | Hs. 198269 | Target CAT | SS, Nop | 4.4 |
| 447987 | BE621544 | Hs. 157160 | hypothetical protein MGC2616 | SS, NDK, LRRNT, LRRCT, LRR | 4.4 |
| 407230 | AA157857 | Hs. 182265 | keratin 19 | filament, bZIP, SS, filament | 4.3 |
| 448886 | AL137291 | Hs. 22451 | hypothetical protein FLJ10357 | SS, PH, RhoGEF, SS, rnaseA | 4.3 |
| 421178 | BE267994 | Hs. 102419 | zinc finger protein | zf-C2H2, SS, TM | 4.3 |
| 454031 | R36772 | Hs. 71941 | hypothetical protein MGC15677 | TM | 4.3 |
| 450126 | BE018138 | Hs. 24447 | sigma receptor (SR31747 bindin | SS, ig, fn3 | 4.3 |
| 446557 | U68566 | Hs. 15318 | HS1 binding protein | SS, TM, MIP, UBA | 4.3 |
| 413781 | J05272 | Hs. 850 | IMP (inosine monophosphate) de | IMPDH_C, IMPDH_N, CBS, NPD, S | 4.3 |
| 433251 | AB040955 | Hs. 322735 | KIAA1522 protein | SS, SS, zf-C3HC4, SPRY | 4.3 |
| 420531 | AI652069 | Hs. 98614 | ribosome binding protein 1 (do | bZIP, SS | 4.3 |
| 432179 | X75208 | Hs. 2913 | EphB3 | EPH_lbd, fn3, pkinase, SAM | 4.3 |
| 448988 | Y09763 | Hs. 22785 | gamma-aminobutync acid (GABA) | Neur_chan_LBD, Neur_chan_m | 4.3 |
| 426626 | AI124572 | Hs. 323879 | inhibitor of kappa light polyp | zf-C2H2, SS | 4.3 |
| 432956 | AL037895 | Hs. 279861 | CGI-31 protein | thiored, SS, TM | 4.3 |
| 428970 | BE276891 | Hs. 194691 | retinoic acid induced 3 | 7tm_3, SS, TM | 4.3 |
| 428953 | AA306610 | Hs. 348183 | tumor necrosis factor receptor | TNFR_c6, SS | 4.2 |
| 401128 | | | C12000644: gi|5729785|ref|NP_00 | SS | 4.2 |
| 446899 | NM_005397 | Hs. 16426 | podocalyxin-like | SS, TM, SS, TM | 4.2 |
| 407151 | H25836 | Hs. 301527 | ESTs, Moderately similar to un | SS, TNF | 4.2 |
| 426613 | U96132 | Hs. 171280 | hydroxyacyl-Coenzyme A dehydro | adh_short, SS | 4.2 |
| 408616 | R51604 | Hs. 300842 | KIAA1608 protein | SS, DENN, DENN | 4.2 |
| 446616 | R65964 | Hs. 334873 | ESTs, Weakly similar to ALU8_H | SS, Zn_carbOpept | 4.2 |
| 414467 | AW903820 | Hs. 85752 | copine II | SS | 4.2 |
| 455857 | T70192 | | gb: yc18d03.s1 Stratagene lung | SS, TM, isodh | 4.2 |
| 401751 | | | RAN binding protein 3 | SS, Orexin, SH2, STAT | 4.2 |
| 400563 | | | Target Exon | SS, Pep_M12B_propep | 4.2 |
| 430237 | AI272144 | Hs. 236522 | DKFZP434P106 protein | abhydrolase, TM | 4.2 |
| 406101 | | | C11000273* gi|12656107|gb|AAK0 | SS, TM, 7tm_1 | 4.2 |
| 421661 | BE281303 | Hs. 299148 | hypothetical protein FLJ21801 | SS, VHP | 4.2 |
| 444590 | AA457456 | | hypothetical protein FLJ20435 | SS | 4.2 |
| 408187 | AF034373 | Hs. 43509 | ataxin 2 related protein | SS | 4.2 |
| 437696 | Z83844 | Hs. 5790 | hypothetical protein dJ37E16 5 | SS, Hydrolase, SS, Gal-bind_ | 4.2 |
| 400278 | | | ENSP00000243264: Dolichyl-dipho | SS, TM | 4.2 |
| 407394 | AF005081 | | gb: Homo sapiens skin-specific | SS | 4.2 |
| 447407 | BE387301 | Hs. 18528 | Sjogren's syndrome nuclear aut | SS, HLH, ras, GSHPx | 4.2 |
| 410237 | AI750589 | Hs. 61258 | argininosuccinate lyase | lyase_1, SS | 4.1 |
| 415410 | AF037332 | Hs. 278569 | sorting nexin 17 | PX, fn3, pkinase, SAM, EPH_lb | 4.1 |
| 457757 | AA434109 | Hs. 12271 | f-box and leucine-rich repeat | SS, F-box, SS, TM, HSF_DNA-bi | 4.1 |
| 446388 | AA292979 | Hs. 7788 | NPD007 protein | SS, TM | 4.1 |
| 412825 | AW167439 | Hs. 190651 | Homo sapiens cDNA FLJ13625 fis | SS | 4.1 |
| 439737 | AI751438 | Hs. 41271 | Homo sapiens mRNA full length | SS, C1q, Collagen | 4.1 |
| 422256 | M64673 | Hs. 1499 | heat shock transcription facto | NA, SS, TM, F-box | 4.1 |
| 441164 | AB023180 | Hs. 7724 | KIAA0963 protein | helicase_C, SS, RNA_pol_H | 4.1 |
| 401727 | | | Target Exon | A_deamin, SS | 4.1 |
| 411142 | NM_014256 | Hs. 69009 | transmembrane protein 3 | Galactosyl_T, SS, Ribosomal | 4.1 |
| 458169 | AI961519 | Hs. 140309 | Homo sapiens, clone IMAGE 3677 | SS, pkinase, pkinase_C | 4.1 |
| 432178 | BE265369 | Hs. 272814 | hypothetical protein DKFZp434E | SS, serine_carbpept | 4.1 |
| 421537 | BE383488 | Hs. 105547 | neural proliferation, differen | SS, TM, Glyco_hydro_47 | 4.1 |
| 421380 | D31833 | Hs. 1372 | arginine vasopressin receptor | 7tm_1 | 4.1 |
| 422702 | AJ011373 | Hs. 119285 | chromosome 9 open reading fram | SS, TM, SS, TM | 4.1 |
| 434142 | U47927 | Hs. 3759 | ubiquitin specific protease 5 | zf-UBP, UCH-2, UBA, UCH-1, SS | 4.1 |
| 423696 | Z92546 | | Sushi domain (SCR repeat) cont | SS, TPR, vwd, sushi, Somatome | 4.1 |
| 427407 | BE268649 | Hs. 177766 | ADP-ribosyltransferase (NAD; p | BRCT, PARP, zf-PARP, PARP_re | 4.1 |
| 413749 | AI929320 | Hs. 75516 | tyrosine kinase 2 | pkinase, SS, TM, ig | 4.1 |
| 411927 | BE274009 | Hs. 772 | glycogen synthase 1 (muscle) | Glycos_transf_1, SS | 4.1 |
| 433320 | D60647 | Hs. 250879 | ESTs, Highly similar to CTXN R | SS, TM, rrm | 4.1 |
| 433890 | AF103801 | Hs. 16361 | hypothetical protein | DAO, SS | 4.1 |
| 452603 | AW410601 | Hs. 30026 | HSPC182 protein | SS | 4.1 |
| 444496 | BE302472 | Hs. 11314 | DKFZP564N1363 protein | SS, GKAP, Band_41 | 4.1 |
| 422556 | NM_006245 | Hs. 118244 | protein phosphatase 2, regulat | B56, SS, TM, Atrophin-1, Exo_ | 4.1 |
| 447347 | AA570056 | Hs. 122730 | ESTs, Moderately similar to KI | TM, SS | 4.1 |
| 428284 | AA535762 | Hs. 183435 | NM_004545 Homo sapiens NADH de | SS, TM, Josephin, UIM, Joseph | 4.1 |
| 426551 | AA381268 | Hs. 323947 | ESTs | SS, sushi | 4.0 |
| 417782 | T10149 | Hs. 4243 | hypothetical protein FLJ12650 | SS, TM | 4.0 |
| 443639 | BE269042 | Hs. 9661 | proteasome (prosome, macropain | proteasome, SS, TM, LACT, try | 4.0 |
| 410039 | AF207989 | Hs. 58014 | Homo sapiens, Similar to G pro | SS, TM, 7tm_3, SS, TM | 4.0 |
| 452715 | Z21093 | Hs. 30352 | ribosomal protein S6 kinase, 5 | pkinase | 4.0 |
| 442549 | AI751601 | Hs. 8375 | TNF receptor-associated factor | zf-C3HC4, MATH, zf-TRAF, SS, | 4.0 |
| 430603 | AA148164 | Hs. 247280 | HBV associated factor | SS, zf-C3HC4, zf-RanBP, pkin | 4.0 |
| 427239 | BE270447 | | ubiquitin carrier protein | UQ_con, SS, TM | 4.0 |
| 402665 | | | Target Exon | SS, TM, ig, DSPc | 4.0 |
| 413818 | BE161405 | Hs. 79 | hypothetical protein MGC15429 | SS, KH-domain, WD40, Ribosom | 4.0 |

TABLE 15A-continued

| Pkey | ExAccn | UniGene ID | Unigene Title | Pred Protein Dom | R1 |
|---|---|---|---|---|---|
| 406919 | M88359 | | gb: Homo sapiens DNA-binding pr | SS, rrm | 4.0 |
| 412656 | AF006011 | Hs. 74375 | dishevelled 1 (homologous to D | SS, PDZ, DEP, DIX, Dishevelle | 4.0 |
| 437546 | AW074836 | Hs. 173984 | T-box 1 | SS, TM, T-box, GTP_CDC, LRRCT | 4.0 |
| 419489 | AW411280 | Hs. 90693 | replication initiation region | zf-C2H2, LIM, TM | 4.0 |
| 410043 | D30612 | Hs. 58167 | zinc finger protein 282 | zf-C2H2, KRAB, SS, zf-C2H2, K | 4.0 |
| 430067 | U79458 | Hs. 231840 | WW domain binding protein 2 | GRAM, SS | 4.0 |
| 408449 | NM_004408 | Hs. 166161 | dynamin 1 | PH, GED, dynamin, dynamin_2, | 4.0 |
| 448099 | BE621839 | Hs. 61976 | Homo sapiens cDNA FLJ12947 fis | SS | 4.0 |
| 436656 | N35568 | Hs. 5245 | hypothetical protein FLJ20643 | SS, TM, sugar_tr, PID | 4.0 |
| 424512 | X53002 | Hs. 149846 | integrin, beta 5 | integrin_B, EGF, SS, TM | 4.0 |
| 440346 | AI923985 | Hs. 59621 | ESTs, Weakly similar to A40815 | SS, TM, ig, pkinase | 3.9 |
| 420065 | AW140093 | Hs. 129926 | ESTs | SS, TM | 3.9 |
| 426636 | BE242634 | Hs. 2055 | ubiquitin-activating enzyme E1 | ThiF, UBACT, SS, pkinase, UCH | 3.9 |
| 421579 | NM_002975 | Hs. 105927 | stem cell growth factor; lymph | lectin_c, SS, TM | 3.9 |
| 427498 | NM_003926 | Hs. 178728 | methyl-CpG binding domain prot | SS, HLH | 3.9 |
| 457820 | AA341497 | Hs. 31408 | RAR (RAS like GTPASE) | SS, TM, Rhomboid | 3.9 |
| 439998 | BE559554 | Hs. 61790 | hypothetical protein FLJ23338 | SS, SS, TM, EMP70, PA28_alpha | 3.9 |
| 438662 | AA223599 | Hs. 6351 | cleavage and polyadenylation s | zf-CCHC, zf-CCCH, thaumatin | 3.9 |
| 414303 | NM_004427 | Hs. 165263 | early development regulator 2 | SAM, SS | 3.9 |
| 435406 | F26698 | Hs. 4884 | calcium/calmodulin-dependent p | pkinase, SS, hexokinase, hex | 3.9 |
| 414168 | AW793296 | Hs. 103845 | ESTs, Moderately similar to I5 | SS | 3.9 |
| 451982 | F13036 | Hs. 27373 | Homo sapiens mRNA; cDNA DKFZp5 | SS | 3.9 |
| 418181 | U37012 | Hs. 83727 | cleavage and polyadenylation s | CPSF_A, SS, TM | 3.9 |
| 402793 | | | Target Exon | SS, TM, cyclin, cyclin_C | 3.9 |
| 418681 | AA287786 | Hs. 23449 | insulin receptor tyrosine kina | SS, SH3 | 3.9 |
| 412621 | L40397 | Hs. 74137 | transmembrane trafficking prot | EMP24_GP25L, SS, TM | 3.9 |
| 420631 | AW976530 | Hs. 28355 | hypothetical protein FLJ22402 | SS, TM | 3.9 |
| 438483 | AW966735 | Hs. 321635 | ESTs, Weakly similar to A46302 | SS, TM, IP_trans | 3.9 |
| 431472 | AK001023 | Hs. 256549 | nucleotide binding protein 2 ( | fer4_NifH, ParA, APS_kinase | 3.9 |
| 447800 | AL080092 | Hs. 19610 | DKFZP564N1362 protein | SS, TM, SS, TM | 3.8 |
| 436686 | AW450205 | Hs. 305890 | BCL2-like 1 | TM, Bcl-2, 8H4 | 3.8 |
| 408815 | AW957974 | Hs. 25485 | hypothetical protein FLJ22341 | SS, TM | 3.8 |
| 441196 | BE397802 | Hs. 7744 | NM_007103*. Homo sapiens NADH d | Complex1_51K, SNF2_N, helic | 3.8 |
| 433030 | AW068857 | Hs. 279929 | gp25L2 protein | SS, TM, EMP24_GP25L, SS, TM, G | 3.8 |
| 408721 | BE515274 | Hs. 47062 | polymerase (RNA) II (DNA direc | RNA_POL_M_15 KD, SS, COX7a | 3.8 |
| 435049 | AL122067 | Hs. 4746 | hypothetical protein FLJ21324 | SS, pfkB | 3.8 |
| 431347 | AI133461 | Hs. 251664 | insulin-like growth factor 2 ( | SS, Insulin, Insulin | 3.8 |
| 450835 | BE262773 | Hs. 25584 | hypothetical protein FLJ10767 | ArfGap, SS, vwa, TSPN, fn3, Co | 3.8 |
| 414134 | X60188 | Hs. 861 | mitogen-activated protein kina | pkinase, SS, pkinase, T-box | 3.8 |
| 418090 | U57059 | Hs. 83429 | tumor necrosis factor (ligand) | TNF, SS | 3.8 |
| 448832 | AW245212 | Hs. 22199 | ECSIT | SS, rrm | 3.8 |
| 447256 | AW593008 | Hs. 6126 | hypothetical protein dJ1141E15 | SS, TM, SS, TM | 3.8 |
| 448107 | D45853 | Hs. 20313 | protein tyrosine kinase 2 beta | Focal_AT, pkinase, SS, Pepti | 3.8 |
| 426433 | L38969 | Hs. 169875 | thrombospondin 3 | TSPN, tsp_3, SS, TM, SEA, TSPN | 3.8 |
| 431626 | AL035681 | Hs. 265327 | hypothetical protein DKFZp761I | SS | 3.8 |
| 430956 | AI183529 | Hs. 2706 | glutathione peroxidase 4 (phos | GSHPx, SS, TM, ABC_tran | 3.8 |
| 450998 | BE387614 | Hs. 25797 | splicing factor 3b, subunit 4, | SS, TM, sugar_tr, histone | 3.8 |
| 434899 | BE613631 | Hs. 283565 | FOS-like antigen-1 | bZIP, SS, bZIP, cofilin_ADF, | 3.8 |
| 444734 | NM_001360 | Hs. 11806 | 7-dehydrocholesterol reductase | ERG4_ERG24, SS, TM | 3.8 |
| 411090 | BE165650 | Hs. 339697 | VPS28 protein | SS, TM, CPSF_A | 3.8 |
| 452135 | AI492175 | Hs. 21446 | KIAA1716 protein | SS, DIX, PDZ, DEP, Dishevelle | 3.8 |
| 421339 | AA070224 | Hs. 103561 | SRp25 nuclear protein | SS | 3.7 |
| 406535 | | | Target Exon | SS, TM, Ribosomal_S19e, ig, l | 3.7 |
| 447281 | AA017018 | Hs. 18021 | hypothetical protein FLJ20446 | SS, SS, Tektin, Piwi, PAZ | 3.7 |
| 433126 | AB021262 | Hs. 99816 | beta-catenin-interacting prote | SS, TM | 3.7 |
| 425215 | AF030291 | Hs. 155165 | zinc finger protein-like 1 | PHD, SS, TM, DnaJ, ERG4_ERG24 | 3.7 |
| 420536 | AL117455 | Hs. 275438 | histone deacetylase 7A | Hist_deacetyl, SS, Hist_dea | 3.7 |
| 417998 | AW967420 | | gb: EST379495 MAGE resequences, | SS, TM | 3.7 |
| 430890 | X54232 | Hs. 2699 | glypican 1 | Glypican, SS | 3.7 |
| 427863 | AF189712 | Hs. 181002 | MLL septin-like fusion | SS, GTP_CDC, SS, TM | 3.7 |
| 448606 | BE613362 | | Homo sapiens ubiquitin conjuga | SS, TM | 3.7 |
| 421961 | AB032993 | Hs. 109929 | likely homolog of rat GRIP-ass | TM, K_tetra, ion_trans, HLH, | 3.7 |
| 410293 | AK000047 | Hs. 61960 | hypothetical protein | K_tetra, SS | 3.7 |
| 425233 | Z17861 | Hs. 155218 | E1B-55kDa-associated protein 5 | SPRY, SAP, SS, TM, SPRY, SAP, p | 3.7 |
| 423683 | BE388699 | Hs. 4188 | hypothetical protein MGC10812 | SS, Peptidase_C15, TGF-beta | 3.7 |
| 415697 | AI365603 | Hs. 78605 | DKFZP566I1024 protein | SS, cpn60_TCP1 | 3.7 |
| 415825 | Y18024 | Hs. 78877 | inositol 1,4,5-trisphosphate 3 | SS | 3.7 |
| 418052 | AA350659 | Hs. 83347 | angio-associated, migratory ce | WD40, Bacterial_PQQ, TM, UPF | 3.7 |
| 444706 | AK000398 | Hs. 11747 | hypothetical protein FLJ20391 | SS, SS, TM | 3.7 |
| 407381 | AA420659 | Hs. 183110 | ESTs, Weakly similar to ALUC_H | SS, TM | 3.7 |
| 423432 | BE252996 | Hs. 44067 | ESTs | TM | 3.7 |
| 444982 | AK002182 | Hs. 12211 | GDP-fucose transporter 1 | SS, TM, DUF6, SS, TM | 3.7 |
| 407777 | AA161071 | Hs. 71465 | squalene epoxidase | SS, TM, Monooxygenase | 3.7 |
| 422715 | AA332178 | Hs. 119403 | hexosaminidase A (alpha polype | Glyco_hydro_20, Glyco_hydr | 3.7 |
| 422609 | Z46023 | Hs. 118721 | sialidase 1 (lysosomal sialida | SS, TM, BNR, SS, TM, SET, HSP70 | 3.7 |
| 414732 | AW410976 | Hs. 77152 | minichromosome maintenance def | MCM, RIP, SS, zf-C2H2, KRAB | 3.7 |
| 452579 | AA131657 | Hs. 23830 | ESTs | SS, CN_hydrolase | 3.7 |

TABLE 15A-continued

| Pkey | ExAccn | UniGene ID | Unigene Title | Pred Protein Dom | R1 |
|---|---|---|---|---|---|
| 419032 | W81330 | Hs. 58643 | ESTs, Highly similar to JAK3B | SS, pkinase, SH2, Insulin, pk | 3.6 |
| 411165 | NM_000169 | Hs. 69089 | galactosidase, alpha | Melibrase, Ribosomal_L44, z | 3.6 |
| 444000 | AI095034 | Hs. 135528 | ESTs | SS, HLH | 3.6 |
| 441174 | BE312775 | Hs. 294005 | *Homo sapiens*, clone IMAGE.3050 | SS, TM | 3.6 |
| 429491 | NM_012111 | Hs. 204041 | chromosome 14 open reading fra | SS | 3.6 |
| 438433 | AB018274 | Hs. 6214 | KI440731 protein | SS | 3.6 |
| 425162 | BE514851 | Hs. 154886 | choline kinase-like | Carn_acyltransf, Choline_k | 3.6 |
| 429671 | BE379335 | Hs. 211594 | proteasome (prosome, macropain | AAA, NB-ARC, TM | 3.6 |
| 421018 | AI569028 | Hs. 129888 | hypothetical protein FLJ14768 | zf-C2H2, SS, rrm, ENTH | 3.6 |
| 433604 | NM_013442 | Hs. 3439 | stomatin-like 2 | Band_7, SS, TM, AAA cdc48_N, | 3.6 |
| 451544 | AK000429 | Hs. 26570 | hypothetical protein FLJ20422 | SS, TM, COX3, SS, SRF-TF | 3.6 |
| 444369 | AV649296 | Hs. 282793 | ESTs | SS | 3.6 |
| 406660 | X65371 | Hs. 172550 | polypyrimidine tract binding p | rrm, beta-tactamase, SS, try | 3.6 |
| 456503 | AW977779 | Hs. 194613 | ESTs | SS, TM, bromodomain, abhydro | 3.6 |
| 451711 | AK000461 | Hs. 26890 | cat eye syndrome chromosome re | SS, SS, TM, A_deaminase | 3.6 |
| 425394 | AA356730 | Hs. 323949 | kangai 1 (suppression of tumor | SS, TM, transmembrane4 | 3.6 |
| 428011 | BE387514 | Hs. 181418 | KIAA0152 gene product | Acyl-CoA_dh, SS, efhand | 3.6 |
| 407627 | AI419020 | Hs. 62620 | chromosome 6 open reading fram | SS | 3.6 |
| 436437 | F12200 | Hs. 5811 | chromosome 21 open reading fra | SS, Syja_N, Exo_endo_phos | 3.6 |
| 419418 | X75621 | Hs. 90303 | tuberous sclerosis 2 | Rap_GAP, Tuberin, Peptidase | 3.6 |
| 440300 | N39760 | Hs. 8859 | *Homo sapiens*, Similar to RIKEN | SS | 3.6 |
| 448136 | AA036680 | Hs. 20447 | protein kinase related to S c | pkinase, PBD | 3.6 |
| 435977 | AL138079 | Hs. 5012 | brain-specific membrane-anchor | SS, TM, SS, TM, ubiquitin, Rib | 3.6 |
| 419095 | AA234009 | Hs. 188715 | ESTs | pkinase, PH, pkinase_C | 3.6 |
| 447267 | AL360143 | Hs. 17936 | DKFZP434H132 protein | SS | 3.6 |
| 418054 | NM_002318 | Hs. 83354 | lysyl oxidase-like 2 | SRCR, Lysyl_oxidase, SS, TM, | 3.6 |
| 444354 | AA847582 | Hs. 10927 | hypothetical protein R33729_1 | SS | 3.6 |
| 429098 | AF030249 | Hs. 196176 | enoyl Coenzyme A hydratase 1, | ECH, Herpes_V23, SS, Gal-bin | 3.6 |
| 430622 | BE616971 | Hs. 247478 | *Homo sapiens*, Similar to DNA s | G-patch, SS, TM, ubiquitin, a | 3.6 |
| 440675 | AW005054 | Hs. 47883 | ESTs, Weakly similar to KCC1_H | pkinase | 3.6 |
| 409678 | NM_005632 | Hs. 55836 | small optic lobes (Drosophila) | TM, Peptidase_C2 | 3.6 |
| 413097 | BE383876 | Hs. 75196 | ankyrin repeat-containing prot | ank, SET, SS, TM, pkinase, SH2 | 3.6 |
| 427579 | AA366143 | Hs. 179669 | hypothetical protein FLJ20637 | HECT, SS, HECT | 3.6 |
| 409154 | U72882 | Hs. 50842 | interferon-induced protein 35 | SS, ras, Ribosomal_L27e, KOW | 3.5 |
| 448528 | BE613248 | Hs. 172084 | *Homo sapiens*, clone IMAGE 3627 | SS, PID, SH2 | 3.5 |
| 444426 | AL121105 | Hs. 11170 | RNA binding motif protein 14 | rrm, SS, spectrin, PH, rrm, so | 3.5 |
| 409297 | R34662 | Hs. 53066 | hsp70-interacting protein | SS | 3.5 |
| 441138 | T56785 | Hs. 10101 | hypothetical protein FLJ12875 | SS | 3.5 |
| 435169 | AF148509 | Hs. 279881 | mannosidase, alpha, class 1B, | TM, Glyco_hydro_47 | 3.5 |
| 422575 | AK000546 | Hs. 118552 | hypothetical protein FLJ20539 | TM, SS, TM, SRCR, Glyco_trans | 3.5 |
| 403325 | | | C2000428* gi|7705383|ref|NP_05 | SS | 3.5 |
| 437895 | AB014568 | Hs. 5898 | KIAA0668 protein | TM, UL21, Lipoprotein_6, GBP | 3.5 |
| 449030 | AI365582 | Hs. 57100 | *Homo sapiens* mRNA for FLJ00016 | SS, Synuclein | 3.5 |
| 426542 | AF190746 | Hs. 170310 | cat eye syndrome chromosome re | A_deaminase, SS, TM, Hydrola | 3.5 |
| 439873 | BE159253 | Hs. 300638 | ESTs | SS | 3.5 |
| 428950 | BE311879 | Hs. 194673 | phosphoprotein enriched in ast | DED, SS, TM, Calsequestrin | 3.5 |
| 421564 | AB007864 | Hs. 105850 | KIAA0404 protein | SS | 3.5 |
| 441094 | U33819 | Hs. 7647 | MYC-associated zinc finger pro | SS, zf-C2H2, LIM, PHD, TFIIS, | 3.5 |
| 450007 | BE270693 | Hs. 24301 | polymerase (RNA) II (DNA direc | NA, SS | 3.5 |
| 422898 | AL043101 | Hs. 127401 | DKFZP434A163 protein, selectiv | SS, TM | 3.5 |
| 444914 | AA046947 | Hs. 12142 | WD repeat domain 13 | WD40, SS, TBC, rrm | 3.5 |
| 420178 | D50550 | Hs. 95659 | lethal giant larvae (Drosophil | WD40, SS, TM | 3.5 |
| 418984 | AA421401 | | ribosomal protein L18 | SS, TM | 3.5 |
| 414166 | AW888941 | Hs. 75789 | N-myc downstream regulated | Ndr, abhydrolase, SS | 3.5 |
| 409944 | BE297925 | Hs. 57687 | four and a half LIM domains 3 | LIM, SS | 3.5 |
| 421458 | NM_003654 | Hs. 104576 | carbohydrate (keratan sulfate | SS | 3.5 |
| 423599 | AI805664 | Hs. 31731 | peroxiredoxin 5 | AhpC-TSA, SS, hormone_rec, z | 3.5 |
| 427715 | BE245274 | Hs. 180428 | KIAA1181 protein | TM, SS, TM, KOW | 3.5 |
| 405496 | | | Target Exon | SS, tubulin, SS | 3.5 |
| 417911 | AA333387 | Hs. 82916 | chaperonin containing TCP1, su | cpn60_TCP1, SS, cpn60_TCP1 | 3.5 |
| 433620 | AA604520 | Hs. 269468 | ESTs, Moderately similar to AL | SS, UCH-2, UCH-1 | 3.5 |
| 430053 | AF052155 | Hs. 227949 | SEC13 (*S. cerevisiae*)-like 1 | WD40, SS, TM, E1–E2_ATPase, C | 3.5 |
| 458687 | AW024815 | Hs. 170088 | GLUT4 enhancer factor | SS | 3.5 |
| 424679 | AL117477 | Hs. 119960 | DKFZP727G051 protein | chromo, SS | 3.5 |
| 417360 | AW651703 | Hs. 82023 | hypothetical protein similar t | SS, TM, GDA1_CD39, GDA1_CD39 | 3.5 |
| 439641 | AI251317 | Hs. 33184 | ESTs | SS, TM, GYF, actin, PA | 3.5 |
| 426437 | BE076537 | Hs. 169895 | ubiquitin-conjugating enzyme E | UQ_con, SS, TM, Armadillo_se | 3.5 |
| 427117 | BE258946 | Hs. 173611 | Target CAT | complex1_49 Kd, SS, TM, ITAM, | 3.4 |
| 422051 | AW327546 | Hs. 111024 | solute carrier family 25 (mito | SS, mito_carr, SS, mito_carr | 3.4 |
| 422759 | AA316582 | Hs. 224571 | ESTs | SS | 3.4 |
| 417230 | U40998 | Hs. 81728 | unc119 (*C. elegans*) homolog | SS, glycolytic_enzy | 3.4 |
| 450158 | AK001999 | Hs. 24545 | hypothetical protein FLJ11137 | SS, zf-C2H2, SCAN, TFIIS, SS | 3.4 |
| 425421 | L11669 | Hs. 157145 | tetracycline transporter-like | SS, TM, SS, TM | 3.4 |
| 415515 | F11327 | Hs. 167406 | gb: HSC2VD101 normalized infant | SS | 3.4 |
| 427868 | AI360119 | Hs. 181013 | phosphoglycerate mutase 1 (bra comp | PGAM, SS, TM, Idh | 3.4 |
| 413503 | BE410228 | Hs. 75410 | heat shock 70 kD protein 5 (glu | SS, HSP70, homeobox, Hydanto | 3.4 |

TABLE 15A-continued

| Pkey | ExAccn | UniGene ID | Unigene Title | Pred Protein Dom | R1 |
|---|---|---|---|---|---|
| 413014 | AW250533 | Hs. 75139 | partner of RAC1 (arfaptin 2) | SS, hemopexin, Filamin, NHL, | 3.4 |
| 457655 | AA622968 | Hs. 71574 | hypothetical protein FLJ14926 | SS, P5CR, EF1BD | 3.4 |
| 419432 | AK001459 | Hs. 90375 | hypothetical protein FLJ10597 | PEP-utilizers, PEP-utilize | 3.4 |
| 421066 | AU076725 | Hs. 101408 | branched chain aminotransferas | aminotran_4, TM | 3.4 |
| 428038 | AW134756 | Hs. 192477 | ESTs | SS, Exonuclease, zf-C2H2 | 3.4 |
| 430352 | AW750535 | Hs. 50742 | Homo sapiens cDNA FLJ23331 fi | TM | 3.4 |
| 432647 | AI807481 | Hs. 278581 | fibroblast growth factor recep | ig, pkinase, SS, TM, ig, pkina | 3.4 |
| 421310 | AW630087 | Hs. 103315 | trinucleotide repeat containin | TM, zf-C2H2, SS, PHD | 3.4 |
| 420999 | AA338903 | Hs. 100915 | peroxisomal biogenesis factor | SS | 3.4 |
| 409561 | U58048 | Hs. 183138 | procollagen (type III) N-endop | SS, TM | 3.4 |
| 419727 | AW160796 | Hs. 92700 | DKFZP564O243 protein | Herpes_env, SS, TM, Peptidas | 3.4 |
| 421267 | BE314724 | Hs. 103081 | ribosomal protein S6 kinase, 7 | pkinase, pkinase_C, SS | 3.4 |
| 411501 | AB002368 | Hs. 70500 | KIAA0370 protein | SS, TM, SS, TM | 3.4 |
| 448741 | BE614567 | Hs. 19574 | hypothetical protein MGC5469 | SS | 3.4 |
| 407103 | AA424881 | Hs. 256301 | hypothetical protein MGC13170 | SS, TM, trypsin | 3.4 |
| 422808 | AA449014 | Hs. 121025 | chromosome 11 open reading fra | SS, TM, trypsin, CUB, ubiquit | 3.4 |
| 448173 | N95657 | Hs. 6820 | ESTs, Moderately similar to YO | SS | 3.4 |
| 416535 | H61851 | | gb: yr80e10.r1 Soares fetal liv | SS, TM, homeobox, LIM | 3.4 |
| 406656 | M16714 | Hs. 181392 | major histocompatibility compl | MHC_I, ig, SS, TM | 3.4 |
| 435669 | AI867781 | Hs. 31819 | HT014 | SS, abhydrolase_2 | 3.4 |
| 411077 | AW977263 | Hs. 68257 | general transcription factor l | SS, TM, TGF-beta | 3.4 |
| 427062 | AW327785 | Hs. 173421 | KIAA1564 protein | SS, Peptidase_M24 | 3.4 |
| 421890 | AW959486 | Hs. 21732 | ESTs | SS, zf-C3HC4, SPRY | 3.4 |
| 412968 | AW500508 | Hs. 75102 | alanyl-tRNA synthetase | DHHA1, SS, tRNA-synt_2c, DHH | 3.4 |
| 439496 | BE616501 | Hs. 32343 | Homo sapiens, Similar to RIKEN | SS | 3.4 |
| 433659 | AK001301 | Hs. 3487 | hypothetical protein FLJ10439 | WD40, SS, TM, Syntaxin, Synta | 3.3 |
| 447578 | AA912347 | Hs. 136585 | ESTs, Weakly similar to JC5314 | SS | 3.3 |
| 441722 | AW960504 | Hs. 173103 | FE65-LIKE 2 | SS, TM | 3.3 |
| 452345 | AA293279 | Hs. 29173 | hypothetical protein FLJ20515 | DSPc, SS, jmjC, F-box | 3.3 |
| 451714 | AK000344 | Hs. 26898 | hypothetical protein FLJ20337 | SS, TBC, FHA, zf-C3HC4 | 3.3 |
| 410633 | BE546789 | Hs. 346742 | hypothetical protein MGC3260 | SS, TM | 3.3 |
| 410609 | BE298441 | Hs. 287361 | ADP-ribosylation factor relate | arf, ras, SS, arf, Stathmin | 3.3 |
| 414775 | AA992036 | Hs. 172702 | ESTs, Weakly similar to (defli | SS, PCI | 3.3 |
| 428495 | NM_013279 | Hs. 184640 | hypothetical protein MGC10781 | SS, TM, XPG_N, XPG_I, 5_3_exo | 3.3 |
| 429215 | NM_005341 | Hs. 2364 | GLI-Kruppel family member HKR3 | zf-C2H2, BTB, TP2, K_tetra, S | 3.3 |
| 446618 | AL110307 | Hs. 15591 | COP9 subunit 6 (MOV34 homolog, | Mov34, SS, zf-C2H2, SCAN | 3.3 |
| 444868 | BE560471 | Hs. 12101 | hypothetical protein | SS, PCI | 3.3 |
| 430041 | AW247237 | Hs. 227835 | KIAA1049 protein | SS, TM, 7tm_1, tubulin | 3.3 |
| 416950 | AL049798 | Hs. 80552 | dermatopontin | SS | 3.3 |
| 431203 | AW248421 | Hs. 250758 | proteasome (prosome, macropain | AAA, Sigma54_activat, SS, TP | 3.3 |
| 432714 | Y12059 | Hs. 278675 | bromodomain-containing 4 | bromodomain, SS, TM, SNF2_N, | 3.3 |
| 415674 | BE394784 | Hs. 78596 | proteasome (prosome, macropain | SS, proteasome, SS, TM, Cadhe | 3.3 |
| 426152 | BE299190 | Hs. 167246 | P450 (cytochrome) oxidoreducta | flavodoxin, FAD_binding, SS | 3.3 |
| 418440 | NM_006936 | Hs. 85119 | SMT3 (suppressor of mif two 3, | ubiquitin, SS, UQ_con | 3.3 |
| 410545 | U32324 | Hs. 64310 | interleukin 11 receptor, alpha | ig, fn3, SS, TM, GalP_UDP_tra | 3.3 |
| 409428 | M33680 | Hs. 54457 | CD81 antigen (target of antipr | transmembrane4, cyclin, SS, | 3.3 |
| 443121 | Z19267 | Hs. 9006 | VAMP (vesicle-associated membr | TM, MSP_domain | 3.3 |
| 453856 | AA804789 | Hs. 19447 | PDZ-LIM protein mystique | LIM, SS, SH3, Sorb | 3.3 |
| 430137 | NM_005456 | Hs. 234249 | mitogen-activated protein kina | SS, SH3, PID, SS, PID | 3.3 |
| 446427 | AW295863 | Hs. 119632 | ESTs | SS | 3.3 |
| 400747 | | | Target Exon | fn3, ig | 3.3 |
| 445580 | AF167572 | Hs. 12912 | skb1 (S pombe) homolog | SS, SS | 3.3 |
| 452568 | AA805634 | Hs. 300870 | Homo sapiens mRNA; cDNA DKFZp5 | SS, rrm, Ephrin, pkinase, ATP | 3.3 |
| 418558 | AW082266 | Hs. 86131 | Fas (TNFRSF6)-associated via d | death, DED, SS, TM | 3.3 |
| 401655 | | | Target Exon | SS | 3.3 |
| 429460 | D56263 | Hs. 203238 | phosphodiesterase 1B, calmodul | PDEase, SS, PDEase | 3.3 |
| 416448 | L13210 | Hs. 79339 | lectin, galactoside-binding, s | SRCR, SS, TM | 3.3 |
| 433038 | AF192559 | Hs. 279939 | mitochondrial carrier homolog | TM, mito_carr, TM | 3.3 |
| 440251 | AW796016 | Hs. 332012 | Homo sapiens, clone IMAGE 3687 | SS, TM, SS, TM, IRK | 3.3 |
| 412922 | M60721 | Hs. 74870 | H2 0 (Drosophila)-like homeo b | SS, homeobox, SS | 3.3 |
| 432941 | W04803 | Hs. 279851 | hypothetical protein FLJ10241 | SS, RNase_PH, RNase_PH_C | 3.3 |
| 441244 | BE612935 | Hs. 184052 | PP1201 protein | SS, TM, WD40 | 3.3 |
| 438175 | AI376727 | Hs. 122110 | ESTs | SS, TM, trypsin, kringle, fn2 | 3.3 |
| 423024 | AA593731 | Hs. 325823 | ESTs, Moderately similar to AL | SS, TM, CD36, CD36 | 3.3 |
| 430120 | AW675298 | Hs. 233694 | hypothetical protein FLJ11350 | SS | 3.3 |
| 419571 | AW674962 | Hs. 91146 | protein kinase D2 | pkinase, DAG_PE-bind, PH, DC | 3.3 |
| 413019 | BE281604 | Hs. 75140 | low density lipoprotein-relate | SS | 3.3 |
| 400729 | X07730 | Hs. 171995 | kallikrein 3, (prostate specif | trypsin, SS, trypsin, trypsi | 3.3 |
| 433519 | BE263901 | | ESTs, Weakly similar to S37431 | SS, TM | 3.2 |
| 434702 | AL039734 | Hs. 4099 | nardilysin (N-arginine dibasic | Peptidase_M16, HCO3_cotran | 3.2 |
| 422242 | AJ251760 | Hs. 273385 | guanine nucleotide binding pro | G-alpha, arf, SS, G-alpha | 3.2 |
| 430480 | AL079399 | Hs. 241543 | DKFZP586F1524 protein | SS, TM, hemopexin, Somatomed | 3.2 |
| 452438 | BE514230 | Hs. 29595 | JM4 protein | SS, TM, KOW, HLH | 3.2 |
| 456939 | AA431633 | Hs. 163867 | NM_002488*: Homo sapiens NADH d | SS, tRNA-synt_2b, WHEP-TRS, | 3.2 |
| 421009 | AL049709 | Hs. 343357 | Human DNA sequence from clone | TM | 3.2 |
| 411969 | X12458 | Hs. 72980 | Protein P3 | SBF, SS, TM, G6PD, G6PD_C, hex | 3.2 |
| 409197 | N54706 | Hs. 303025 | chromosome 11 open reading fra | SS | 3.2 |

TABLE 15A-continued

| Pkey | ExAccn | UniGene ID | Unigene Title | Pred Protein Dom | R1 |
|---|---|---|---|---|---|
| 417896 | AA379770 | Hs. 82890 | defender against cell death 1 | DAD, SS, TM | 3.2 |
| 418026 | BE379727 | Hs. 83213 | fatty acid binding protein 4, | lipocalin, SS, lipocalin | 3.2 |
| 409057 | AA702305 | Hs. 180060 | ESTs | SS, TGFb_propeptide, TGF-be | 3.2 |
| 437869 | W91976 | Hs. 290834 | ESTs | SS, TM, SH3, zf-C3HC4 | 3.2 |
| 413211 | AW967107 | Hs. 109274 | hypothetical protein MGC4365 | SS, TM | 3.2 |
| 425080 | AI393498 | | inositol 1,4,5-triphosphate re | SS, CTF_NFI | 3.2 |
| 445363 | NM_005993 | Hs. 12570 | tubulin-specific chaperone d | ATP-synt_B, HEAT_PBS, SS, TM | 3.2 |
| 421943 | BE616520 | Hs. 343912 | Homo sapiens, Similar to RIKEN | SS, TM, SS, TM | 3.2 |
| 443337 | Y07604 | Hs. 9235 | non-metastatic cells 4, protei | NDK, SS, adh_short, NDK | 3.2 |
| 418885 | D17530 | Hs. 89434 | drebrin 1 | cofilin_ADF, SS, cofilin_AD | 3.2 |
| 411817 | BE302900 | Hs. 72241 | mitogen-activated protein kina | pkinase, SS | 3.2 |
| 413891 | BE271020 | | tumor suppressor deleted in or | SS, TM | 3.2 |
| 449455 | T60748 | Hs. 278408 | hypothetical protein | TM | 3.2 |
| 419193 | D29643 | Hs. 34789 | dolichyl-diphosphooligosacchar | SS, TM, DDOST_48 kD, VP7, SS, T | 3.2 |
| 406701 | AA780613 | Hs. 62954 | ferritin, heavy polypeptide 1 | SS, TM, UDPGT | 3.2 |
| 436467 | AW450278 | Hs. 91681 | ESTs, Weakly similar to DCHUO | SS, tRNA-synt_1b, tRNA_bind | 3.2 |
| 446334 | U52427 | Hs. 14839 | polymerase (RNA) II (DNA direc | S1, SS | 3.2 |
| 410270 | AF279142 | Hs. 195727 | tumor endothelial marker 1 pre | SS, TM, EGF, lectin_c, sushi, | 3.2 |
| 445411 | AL137255 | Hs. 12646 | hypothetical protein FLJ22693 | SS, hormone_rec, zf-CCCH | 3.2 |
| 458018 | AI199575 | Hs. 37716 | ESTs | SS, TM, Oxysterol_BP | 3.2 |
| 426530 | U24578 | Hs. 278625 | complement component 4A | SS, A2M, NTR, A2M_N.prenyltr | 3.2 |
| 445604 | T08566 | Hs. 12956 | Tax interaction protein 1 | PDZ, SS, TM, P2X_receptor, FG | 3.2 |
| 443402 | U77846 | | elastin (supravalvular aortic | SS, PDZ, LIM, pkinase | 3.2 |
| 432416 | BE410937 | Hs. 2985 | emerin (Emery-Dreifuss muscula | LEM, SS, Ribosomal_L10e, Acy | 3.2 |
| 429662 | AI929701 | Hs. 211586 | phosphoinositide-3-kinase, reg | SH2, SH3, RhoGAP, SS, GILT, SH | 3.2 |
| 429150 | AF120103 | Hs. 197366 | smoothened (Drosophila) homolo | SS, TM, Fz, Frizzled, 7tm_2, S | 3.2 |
| 427729 | AB033100 | Hs. 300646 | KIAA1274 protein (similar to m | SS | 3.2 |
| 418151 | AA864238 | Hs. 83583 | actin related protein 2/3 comp comp | RhoGEF, REV, PH, SS, TM, Ribos | 3.2 |
| 448250 | NM_016034 | Hs. 20776 | mitochondrial ribosomal protei | Ribosomal_S2, SS, lipocalin | 3.2 |
| 431158 | AW859138 | Hs. 136280 | Homo sapiens cDNA: FLJ22288 fi | SS, Exonuclease | 3.2 |
| 414292 | BE388407 | Hs. 75875 | ubiquitin-conjugating enzyme E | UQ_con, SS, TM, SAM_PNT | 3.2 |
| 406307 | | | Target Exon | SS, TM, 7tm_2, SS, TM, 7tm_2, G | 3.2 |
| 423325 | R55565 | Hs. 347286 | hypothetical protein FLJ22427 | SS, TM, Surp, ubiquitin, TBC | 3.2 |
| 427584 | BE410293 | Hs. 179718 | v-myb avian myeloblastosis vir | NA, SS | 3.1 |
| 419069 | AA233801 | | ESTs, Weakly similar to CA13_H | SS | 3.1 |
| 431717 | BE396150 | Hs. 6945 | mitochondrial ribosomal protei | SS, TM | 3.1 |
| 448381 | D61580 | Hs. 21036 | Homo sapiens mRNA, cDNA DKFZp4 | RhoGAP, SS, TM, SET, zf-CXXC, | 3.1 |
| 419394 | AB011124 | Hs. 90232 | KIAA0552 gene product | SS, ig | 3.1 |
| 436240 | BE388673 | Hs. 5086 | hypothetical protein MGC10433 | SS, TM, Ets, COX6B, transmemb | 3.1 |
| 413900 | AW409747 | Hs. 75612 | stress-induced-phosphoprotein | TPR, SS, TM, DnaJ | 3.1 |
| 417920 | S47833 | Hs. 82927 | adenosine monophosphate deamin | A_deaminase, SS, G-alpha, GS | 3.1 |
| 421819 | NM_013403 | Hs. 108665 | zinedin | WD40, pkinase, pkinase | 3.1 |
| 426362 | BE267158 | Hs. 169474 | DKFZP586J0119 protein | IF-2B, SS, PP2C | 3.1 |
| 408917 | AW249025 | Hs. 7768 | fibroblast growth factor (acid | SS, bZIP, cofilin_ADF, EGF | 3.1 |
| 443099 | AI372836 | Hs. 9003 | hypothetical protein FLJ13868 | TM | 3.1 |
| 427022 | AW245839 | Hs. 173255 | small nuclear ribonucleoprotei | rrm, SS, rrm, SH3, ras, 2OG-Fe | 3.1 |
| 452711 | AW967047 | Hs. 293224 | ESTs, Weakly similar to T00375 | SS | 3.1 |
| 407236 | W79485 | Hs. 173980 | nuclear matrix protein NMP200 | WD40, SS, TM, PTR2, 7tm_1 | 3.1 |
| 452537 | AW247390 | Hs. 77735 | hypothetical protein FLJ11618 | SS, SNF2_N, helicase_C | 3.1 |
| 452139 | AA099969 | Hs. 16331 | Homo sapiens cDNA: FLJ21482 fi | SS | 3.1 |
| 447629 | AF034790 | Hs. 19105 | translocase of inner mitochond | Tim17, SS, TM, pkinase, OTU | 3.1 |
| 401097 | | | C12000858* gi|7363437|refNP_0 | SS, TM, 7tm_1, SS | 3.1 |
| 452736 | C01164 | Hs. 4232 | Homo sapiens PAC clone RP1-130 | SS, SS, TM, TBC, Surp, ubiquit | 3.1 |
| 435507 | AI143579 | Hs. 26510 | vacuolar protein sorting 33B ( | SS, Sec1, Sec1 | 3.1 |
| 424934 | U75370 | Hs. 153880 | polymerase (RNA) mitochondrial | PPR, SS, TM, cNMP_binding, RN | 3.1 |
| 413245 | BE244334 | Hs. 75249 | ADP-ribosylation factor-like 6 | SS, TM, kazal, Ribosomal_S8, | 3.1 |
| 409858 | NM_006586 | Hs. 56828 | trinucleotide repeat containin | SS, SS, TM, B56 | 3.1 |
| 424582 | AF026849 | Hs. 150922 | BCS1 (yeast homolog)-like | AAA, SS, PI-PLC-X, PH, PI-PLC | 3.1 |
| 431677 | AK000496 | Hs. 306989 | hypothetical protein FLJ20489 | SS | 3.1 |
| 417947 | AA323563 | Hs. 325309 | hypothetical protein FLJ14596 | SS, TM, PTPA | 3.1 |
| 409283 | NM_004860 | Hs. 52788 | fragile X mental retardation, | KH-domain, SS, TM, HMG_box | 3.1 |
| 412813 | AF086947 | Hs. 74617 | dynactin 1 (p150, Glued (Droso | CAP_GLY, SS | 3.1 |
| 456535 | AA305079 | Hs. 1342 | cytochrome c oxidase subunit V | COX5B, SS, p450, actin | 3.1 |
| 432482 | L19267 | Hs. 275924 | dystrophia myotonica-containin | WD40, SS, pkinase, pkinase | 3.1 |
| 437256 | AL137404 | Hs. 97871 | Homo sapiens, clone IMAGE 3845 | TM, SS | 3.1 |
| 440191 | AI990417 | | tubulin, beta 5 | SS, formiminotr, prenyltran | 3.0 |
| 407972 | AA827619 | Hs. 18587 | KIAA1588 protein | SS, TM | 3.0 |
| 420890 | AA434058 | Hs. 100071 | 6-phosphogluconolactonase | Glucosamine_iso, SS | 3.0 |
| 440060 | AI696387 | Hs. 126451 | ESTs, Weakly similar to A46302 | SS | 3.0 |
| 452222 | AW806287 | Hs. 21432 | SEX gene | SS, TM, Sema, TIG, PSI, GDI | 3.0 |
| 401772 | | | NM_014520 Homo sapiens MYB bin | SS | 3.0 |
| 453754 | AW972580 | Hs. 172753 | ESTs | SS, TM, ras, Ribosomal_S19, T | 3.0 |
| 423865 | H05202 | Hs. 133968 | FGF receptor activating protei | SS, TM | 3.0 |
| 450962 | BE535647 | Hs. 25723 | Sjogren's syndrome/scleroderma | SS, TM | 3.0 |
| 441954 | AI744935 | Hs. 8047 | Fanconi anemia, complementatio | TPR, SS, TM, AAA, cdc48_N, Ban | 3.0 |
| 412787 | D87452 | Hs. 74579 | KIAA0263 gene product | zf-CCCH, SS, TM, NTP_transfe | 3.0 |

TABLE 15A-continued

| Pkey | ExAccn | UniGene ID | Unigene Title | Pred Protein Dom | R1 |
|---|---|---|---|---|---|
| 422034 | AC006486 | Hs. 333069 | Ets2 repressor factor | Ets, SS, pkinase, PAF-AH_lb | 3.0 |
| 450788 | AI738410 | | ESTs | SS, TM | 3.0 |
| 452511 | BE408178 | Hs. 285165 | *Homo sapiens* cDNA FLJ20845 fis | SS, thiored, P5CR | 3.0 |
| 414380 | BE391815 | Hs. 75981 | ubiquitin specific protease 14 | UCH-2, UCH-1, ubiquitin, SS | 3.0 |
| 407597 | AA043925 | Hs. 339352 | *Homo sapiens* brother of CDO (B | SS, TM, SS, TM | 3.0 |
| 434955 | BE276128 | Hs. 284286 | mitochondrial ribosomal protei | SS | 3.0 |
| 435632 | AF220049 | Hs. 43549 | uncharacterized hematopoietic | SS, UQ_con | 3.0 |
| 432465 | D56165 | Hs. 275163 | non-metastatic cells 2, protei | NDK, SS, NDK | 3.0 |
| 430526 | AF181862 | Hs. 242407 | G protein-coupled receptor, fa | 7tm_3, homeobox, SS, TM | 3.0 |
| 453412 | AJ003290 | | gb: AJ003290 Selected chromosom | pkinase | 3.0 |
| 446456 | BE613933 | Hs. 15106 | chromosome 14 open reading fra | UPF0143, SS | 3.0 |
| 433180 | AB038651 | Hs. 31854 | K562 cell-derived leucine-zipp | TM, Acetyltransf, TM, Acetyl | 3.0 |
| 447322 | BE617649 | Hs. 77690 | RAB5B, member RAS oncogene fam | SS, oxidored_molyb, heme_1, | 3.0 |
| 422268 | N25485 | Hs. 330310 | maternal G10 transcript | G10, SS, WD40 | 3.0 |
| 419578 | AF064853 | Hs. 91299 | guanine nucleotide binding pro | WD40, SS, EPO_TPO | 3.0 |
| 446929 | AA076132 | Hs. 9460 | *Homo sapiens* mRNA, cDNA DKFZp5 | SS, TM, WD40 | 3.0 |

Pkey: Unique Eos probeset identifier number
ExAccn: Exemplar Accession number, Genbank accession number
UnigeneID Unigene number
Unigene Title Unigene gene title
Pred. Protein Dom: Predicted protein domain
R1: Ratio of tumor to normal body tissue

TABLE 15B

| Pkey | CAT Number | Accession |
|---|---|---|
| 408215 | 10478_1 | BE614290 AA307674 N35629 AA338538 AI193603<br>AA781096 AI680061 AI613258 AW276647 BE221263 AI348910 AI985031 AI090078<br>AI359617 AA666391 AI160210 AI446461 AI355345 AI343638 AI343640 AI275091 M78746 AW262795 AW250002<br>AA503756 AI934519 AW272086 N26520 AA626639 |
| 409938 | 116091_1 | AW974648 AA652153 AA649671 AA078582 |
| 411674 | 1253746_1 | AW861123 AW861125 AW856717 AW861116 AW856706<br>AW856788 AW856774 AW856787 AW856780 AW856782 AW856789 AW856772 AW856784 AW856786 AW856776<br>AW856635 AW856767 |
| 413052 | 1347214_1 | BE249841 BE062657 BE062771 BE062636 BE062813<br>BE062699 BE062895 BE062747 BE062719 BE293541 |
| 413837 | 139363_1 | AW163525 AW163255 AW163385 AI929359 BE279279<br>AA132590 AW157329 AA584408 AW157252 AI692198 AI003514 T24436<br>AI765658 AW157459 AI810740 AI659582 AI969924 AI929284 AI340993 AI349083 AW299522 AW664650 AW299513<br>AAI32529 AI340991 AI912836 AI341293 AI650609 AA279 |
| 413891 | 139759_1 | BE271020 AI763358 AI925430 AI806151 AW003726 T15590 AA649945<br>AW129911 AI570748 T57492 AA828002 AW237602 AW003539<br>AI139045 AI950958 BE042625 AW778973 AI287859 AI983931 AW515101<br>AW150029 AI358496 AI621173 AA846016 AI470921<br>AW169748 AI991000 AW513748 AI04058 |
| 414023 | 1410860_1 | BE243628 BE246081 BE247016 BE241984 BE241534 BE246091<br>BE245679 BE243620 BE245998 BE242329 BE241417 BE241457<br>BE242522 BE241989 BE241464 |
| 416535 | 1599332_1 | H61851 H74099 T67099 |
| 417998 | 171375_1 | AW967420 AA210915 AA236991 AA210916 |
| 418984 | 181094_1 | AA421401 T49326 AA330666 AA328941 W63573 AA758023<br>AA976306 H52254 AA877107 BE207784 AW664584 AI924890 AA458586<br>AI422142 AI891097 AI811174 R69866 T49327 AA233722 AA631138 AA910314<br>AI379416 AI129321 AA861574 AA635649 AI339443<br>AW009533 AA677036 AA948287 AA62 |
| 419069 | 181650_3 | AA233801 BE383487 AA913939 AI632681 AI813277 AI373652<br>AW134802 AI863574 AW305364 AI858557 AI670746 AI015036 AI935384<br>AI935317 AW138668 AW204971 AI765223 AA884146 AA973341 AA234062 |
| 419250 | 183289_2 | AW770185 AW296271 H11254 AW403510 AI032786 AA767046<br>AI376115 AI582209 AA460965 AI868663 AI016900 R05715 AI127382<br>AI660953 AI023644 H00465 AW959578 AA815039 AW292253 R05714 AA815462<br>AA235654 AA461274 W24933 AA300091 H00515 |
| 420160 | 191054_1 | AI492840 AI287657 AA255989 AI698206 AI468558 |
| 421572 | 204022_1 | AA531607 AI565370 AI376907 AI811618 AW138145<br>AW139465 AA421658 AA293069 AW118141 AI214980 AW663502 AI343486<br>AI553789 AA650416 AI498947 |
| 423696 | 23112_1 | Z92546 AA330586 AI570568 AW341487 AI827050 AW298668<br>AI792189 AI015693 AI733599 AI572251 AI672488 AW193262 AI244716<br>AI864375 AI206100 AA912444 AA269365 AI640254 AW772466 AI867336<br>AA627604 H16914 AA358477 AA338009 |

TABLE 15B-continued

| Pkey | CAT Number | Accession |
|---|---|---|
| 425080 | 246559_1 | AI393498 R42314 AI088818 AI696468 AI418641 AA573152 F08817 AI910796 AW338984 R39024 AA729145 BE245956 AI093722 AA541730 F09835 AI242755 AA350447 AA865667 T93903 AW081029 AA493711 AA650030 N35995 N21491 T57002 Z25379 AI906851 |
| 427239 | 27647_1 | BE270447 AW409921 BE207288 BE207170 D56355 BE263223 BE408171 BE262243 BE392439 BE292738 BE261776 BE314300 BE267719 BE268715 BE513876 BE295291 BE297066 AA210923 BE407519 H51344 BE622905 AW248281 AW250313 T19021 AA355115 AA316879 BE269633 BE621936 AA290724 |
| 427391 | 27815_1 | W60675 AK001212 AA155752 AA878366 AA090872 AB033013 AW249107 AA031890 AA112820 AW366388 N55156 AA326756 AW952294 AA180820 C03570 C04358 W60676 AW248674 AA034989 AA044781 AA074274 H26212 AI800572 AI127583 AI951785 AA856557 AI571746 H23835 AI589543 AI215670 |
| 428092 | 286920_1 | AW879141 AA421182 AI734104 AI733923 AA430600 |
| 429545 | 305902_1 | AI824164 AI676005 AW129612 AI825903 AA773987 AI823645 AI823860 AA456229 AI824295 AA454622 AI264049 AI090237 AI669787 AI804012 AI306153 W96164 AI298273 AW884073 AW883986 |
| 430168 | 313927_1 | AW968343 AA468507 AI478223 AW513008 AI762122 AI554512 AA862642 AA468976 |
| 433519 | 368801_2 | BE263901 AA596086 AI190276 AI094806 AI831250 AI572668 AW204652 AI660600 AI922941 R49621 |
| 438707 | 46360_1 | L08239 BE618914 AW385394 AW385398 AW385401 AI922683 AA907337 AA160504 AA928142 AA601969 AA010594 BE618528 AA160591 |
| 440191 | 48804_3 | AI990417 AI304400 AI193071 AI742483 AW003408 AW131566 AI400201 AI656740 AI309186 AW665173 AW204722 AI215122 AI200785 BE467373 AI147599 AI215120 AI076110 AI803429 AI262491 AI808243 AI281007 AW135212 AW205103 AI754349 AI004801 AI051273 AW768918 AW103289 AI4 |
| 443402 | 5681_1 | U77846 AA479373 AA346348 AA348194 M26867 AA728901 AA715367 AA377787 R64236 AI752721 R77311 AA339685 BE074254 AW938712 AW068444 AA330624 AA347098 AA327507 AW391973 AA495763 AA479278 AW605018 T19644 AI204484 AW834745 AW081309 AW090002 AI095659 AI131556 AI56 |
| 444590 | 6116_1 | AA457456 AA907921 AI567715 AA579472 T64216 AA373128 F35533 AA722113 T64403 AA653738 F28806 AA595689 AA047537 AA022499 AW440532 F36782 AI554180 AI183767 AI806052 AA160379 AA481678 AI185031 AI148988 AI174482 AA868833 AI674395 AA481440 AI914985 AI698771 AA44 |
| 445625 | 64558_1 | BE246743 AA436942 AW024744 AW242177 AA975476 AW385185 R07536 R73462 AV654529 T57442 AI399986 R50073 R48743 AI769689 AI863005 AA317806 AI678000 AW189963 AI986207 AW471273 R73463 AI335104 AI590161 AI469257 AI954604 H21954 T25141 AA856793 R50074 AI708253 AI2 |
| 448606 | 77159_1 | BE613362 AA447862 H72036 AA393664 AI681334 AW139128 AA932579 AI302241 AI936800 AW960628 AI492148 C06192 AA336107 AA808008 AW615212 BE297403 BE298978 AI187207 AA928695 AI620631 AA938128 AI346527 AI040261 AA808401 AW130326 AI440313 AA868693 AI653329 AI33246 |
| 448677 | 775217_1 | AI560769 AI857497 AW151454 |
| 450788 | 846840_1 | AI738410 AW016905 AI971725 |
| 452160 | 901991_1 | BE378541 AI863051 |
| 453412 | 966264_1 | AJ003290 AJ003288 AW276947 |
| 455857 | 1376021_1 | T70192 BE147696 |
| 455928 | 1383899_1 | BE170313 BE158339 BE158290 |
| 457022 | 274445_1 | AW377258 BE067468 BE067511 BE067515 BE067467 BE067514 AA397442 |

Pkey: Unique Eos probeset identifier number
CAT number Gene cluster number
Accession Genbank accession numbers

TABLE 15C

| Pkey | Ref | Strand | Nt_position |
|---|---|---|---|
| 400460 | 8389428 | Plus | 35559–36295 |
| 400563 | 9844011 | Plus | 81941–82434 |
| 400747 | 7329330 | Minus | 71249–71441 |
| 400846 | 9188605 | Plus | 39310–39474 |
| 401097 | 9965518 | Minus | 60356–61096 |
| 401128 | 8699792 | Plus | 37349–37885 |
| 401655 | 9099093 | Plus | 79556–80132 |
| 401727 | 8134856 | Plus | 54342–54482 |
| 401751 | 9828651 | Plus | 139165–139322 |
| 401772 | 9966243 | Plus | 183917–184042 |
| 402365 | 9454515 | Minus | 70928–71185 |
| 402463 | 9796896 | Minus | 8818–8952 |
| 402665 | 8077033 | Minus | 11824–12090, 14290–14544 |
| 402793 | 6136940 | Minus | 69012–69165 |
| 402916 | 7406502 | Minus | 361–474, 541–687 |
| 403028 | 7670577 | Minus | 114150–114272 |
| 403325 | 8440025 | Minus | 109763–109926 |
| 404256 | 9367203 | Plus | 146931–147796 |
| 405189 | 7229907 | Minus | 168236–168795 |
| 405325 | 6094661 | Minus | 25818–26380 |
| 405356 | 2155224 | Plus | 36116–36276 |
| 405496 | 8468968 | Plus | 147706–148062 |
| 406101 | 9124019 | Plus | 125325–125831 |

TABLE 15C-continued

| Pkey | Ref | Strand | Nt_position |
|---|---|---|---|
| 406307 | 8576099 | Plus | 95473–95585, 98900–99180 |
| 406535 | 7711477 | Plus | 83135–83362 |

Pkey: Unique number corresponding to an Eos probeset
Ref: Sequence source The 7 digit numbers in this column are Genbank Identifier (GI) numbers. "Dunham I. et al." refers to the publication entitled "The DNA sequence of human chromosome 22" Dunham, et al (1999) Nature 402: 489–495.
Strand Indicates DNA strand from which exons were predicted.
Nt_position Indicates nucleotide positions of predicted exons.

Table 16A lists about 811 genes up-regulated in ovarian cancer compared to normal adult tissues that are likely to encode extracellular or cell-surface proteins These were selected as for Table 14A, except that the ratio of "average" ovarian cancer to "average" normal adult tissues was greater than or equal to 4.0, the "average" ovarian cancer level was set to the 96th percentile value amongst various ovarian cancer specimens, the "average" normal adult tissue level was set to the 75th percentile value amongst various non-malignant tissues, the "average" ovarian cancer value was greater than or equal to 80 units, and the predicted protein contained a structural domain that is indicative of enzymatic function or of transducing an intracellular signal, or of being modulatable by small molecules (e g , pkinase, peptidase, phosphatase, or ion_transporter) Predicted protein domains are noted

TABLE 16A

| Pkey | ExAccn | UniGene ID | Unigene Title | Pred. Protein Dom. | R1 |
|---|---|---|---|---|---|
| 407223 | H96850 | | gb yw03b12 s1 Soares melanocyt | | 58.9 |
| 430281 | AI878842 | Hs. 237924 | CGI-69 protein | mito_carr | 46.7 |
| 410418 | D31382 | Hs. 63325 | transmembrane protease, serine | ldl_recept_a, trypsin | 41.0 |
| 431773 | BE409442 | Hs.268557 | pleckstrin homology-like domai | PH | 37.1 |
| 438424 | AI912498 | Hs.25895 | hypothetical protein FLJ14996 | | 35.3 |
| 418969 | W33191 | Hs. 28907 | hypothetical protein FLJ20258 | SH3 | 35.2 |
| 453028 | AB006532 | Hs. 31442 | RecQ protein-like 4 | DEAD, helicase_C | 28.2 |
| 407722 | BE252241 | Hs. 38041 | pyridoxal (pyridoxine, vitamin | pfkB | 28.2 |
| 451721 | NM_006946 | Hs. 26915 | spectrin, beta, non-erythrocyt | spectrin, PH, CH | 27.9 |
| 416819 | U77735 | Hs. 80205 | pim-2 oncogene | pkinase | 27.9 |
| 430397 | AI924533 | Hs. 105607 | bicarbonate transporter relate | HCO3_cotransp | 27.7 |
| 450334 | AF035959 | Hs. 24879 | phosphatidic acid phosphatase | PAP2 | 26.7 |
| 418945 | BE246762 | Hs. 89499 | arachidonate 5-lipoxygenase | lipoxygenase, PLAT | 25.3 |
| 424420 | BE614743 | Hs.146688 | prostaglandin E synthase | MAPEG | 25.1 |
| 412674 | X04106 | Hs. 74451 | calpain 4, small subunit (30 K) | efhand | 24.4 |
| 430023 | AA158243 | Hs. 227729 | FK506-binding protein 2 (13 kD) | FKBP | 24.3 |
| 444672 | Z95636 | Hs. 11669 | laminin, alpha 5 | laminin_EGF, laminin_G, EGF | 24.0 |
| 413726 | AJ278465 | Hs. 75510 | annexin A11 | annexin | 23.1 |
| 438951 | U51336 | Hs. 6453 | inositol 1,3,4-triphosphate 5/ | oxidored_nitro | 23.0 |
| 429099 | BE439952 | Hs.196177 | phosphorylase kinase, gamma 2 | pkinase | 23.0 |
| 431765 | AF124249 | Hs. 268541 | novel SH2-containing protein 1 | SH2 | 22.4 |
| 422645 | L40027 | Hs. 118890 | glycogen synthase kinase 3 alp | pkinase | 22.4 |
| 413436 | AF238083 | Hs. 68061 | sphingosine kinase 1 | DAGKc | 22.3 |
| 422639 | AI929377 | Hs. 173724 | creatine kinase, brain | ATP-gua_Ptrans, ATP-gua_Pt | 21.5 |
| 429869 | AI907018 | Hs.15977 | Target CAT | | 21.3 |
| 418891 | NM_002419 | Hs. 89449 | mitogen-activated protein kina | SH3, pkinase, pyridoxal_deC | 21.1 |
| 419138 | U48508 | Hs. 89631 | ryanodine receptor 1 (skeletal | RYDR_ITPR, RyR, SPRY, ion_tr | 21.0 |
| 432866 | BE395875 | Hs. 279609 | mitochondrial carner homolog | mito_carr | 20.9 |
| 452875 | BE275760 | Hs. 30928 | DNA segment on chromosome 19 ( | Euk_porin | 20.8 |
| 426997 | BE620738 | Hs. 173125 | peptidylprolyl isomerase F (cy | pro_isomerase | 20.8 |
| 402916 | | | ENSP00000202587* Bicarbonate t | HCO3_cotransp | 20.8 |
| 425760 | D17629 | Hs.159479 | galactosamine (N-acetyl)-6-sul | Sulfatase | 20.7 |
| 400419 | AF084545 | | Target | EGF, ig, lectin_c, sushi, Xli | 20.0 |
| 419444 | NM_002496 | Hs. 90443 | Target CAT | fer4 | 19.5 |
| 459133 | U40343 | Hs. 29656 | cyclin-dependent kinase inhibi | ank | 19.2 |
| 447595 | AW379130 | Hs. 18953 | phosphodiesterase 9A | PDEase | 19.2 |
| 422708 | AB017430 | Hs.119324 | kinesin-like 4 | kinesin, homeobox | 19.0 |
| 414837 | U24266 | Hs.77448 | aldehyde dehydrogenase 4 famil | aldedh | 18.8 |
| 429712 | AW245825 | Hs.211914 | ENSP00000233627* NADH-ubiquino | oxidored_q6 | 18.5 |
| 425848 | BE242709 | Hs. 159637 | valyl-tRNA synthetase 2 | GST_C, GST_N, Tropomyosin | 18.4 |
| 451643 | M64437 | Hs. 234799 | breakpoint cluster region | RhoGEF, RhoGAP, PH, C2 | 18.1 |
| 447859 | AK002194 | Hs. 19851 | peroxisomal biogenesis factor | | 17.5 |
| 426457 | AW894667 | Hs. 169965 | chimerin (chimaerin) 1 | DAG_PE-bind, RhoGAP | 17.3 |
| 421612 | AF161254 | Hs.106196 | 8D6 antigen | ldl_recept_a | 17.1 |
| 421363 | NM_001381 | Hs. 103854 | docking protein 1, 62 kD (downs | PH, IRS | 16.9 |
| 442739 | NM_007274 | Hs. 8679 | cytosolic acyl coenzyme A thio | Acyl-CoA_hydro | 16.8 |
| 420568 | F09247 | Hs. 247735 | protocadherin alpha 10 | cadherin | 16.8 |
| 421445 | AA913059 | Hs.104433 | Homo sapiens, clone IMAGE 4054 | asp | 16.8 |
| 425424 | NM_004954 | Hs. 157199 | ELKL motif kinase | pkinase, KA1, UBA | 16.7 |
| 446329 | NM_013272 | Hs. 14805 | solute carrier family 21 (orga | kazal, OATP_N, OATP_C | 16.5 |
| 406620 | M81105 | Hs. 146550 | myosin, heavy polypeptide 9, n | myosin_head, Myosin_tail, I | 16.4 |
| 429109 | AL008637 | Hs. 196352 | neutrophil cytosolic factor 4 | PX, SH3, OPR | 16.3 |
| 429183 | AB014604 | Hs. 197955 | KIAA0704 protein | PH, Oxysterol_BP | 16.2 |
| 444664 | N26362 | Hs. 11615 | map kinase phosphatase-like pr | DSPc, Rhodanese | 16.2 |

TABLE 16A-continued

| Pkey | ExAccn | UniGene ID | Unigene Title | Pred. Protein Dom. | R1 |
|---|---|---|---|---|---|
| 427640 | AF058293 | Hs.180015 | D-dopachrome tautomerase | MIF, late_protein_L2 | 16.2 |
| 425123 | AW205274 | Hs.154695 | phosphomannomutase 2 | PMM | 16.0 |
| 416006 | AA324251 | Hs. 78950 | branched chain keto acid dehyd | E1_dehydrog | 15.8 |
| 412942 | AL120344 | Hs. 75074 | mitogen-activated protein kina | pkinase | 15.8 |
| 423366 | Z80345 | Hs.127610 | acyl-Coenzyme A dehydrogenase, | Acyl-CoA_dh, Acyl-CoA_dh_M | 15.7 |
| 426391 | AW161050 | Hs. 169611 | second mitochondria-derived ac | | 15.7 |
| 424568 | AF005418 | Hs. 150595 | cytochrome P450, subfamily XXV | p450 | 15.5 |
| 420029 | BE258876 | Hs. 94446 | polyamine-modulated factor 1 | aldo_ket_red | 15.5 |
| 433573 | AF234887 | Hs. 57652 | cadherin, EGF LAG seven-pass G | 7tm_2, EGF, cadherin, lamini | 15.4 |
| 407619 | AL050341 | Hs. 37165 | collagen, type IX, alpha 2 | Collagen | 15.3 |
| 427326 | AI287878 | | gb qv23f06x1 NCI_CGAP_Lym6 Ho | 7tm_1 | 15.2 |
| 442620 | C00138 | Hs. 8535 | *Homo sapiens* mRNA for KIAA1668 | | 15.1 |
| 458130 | AA115811 | Hs.6838 | ras homolog gene family, membe | ras, arf | 15.0 |
| 449936 | AA938293 | Hs. 60088 | hypothetical protein MGC11314 | | 15.0 |
| 409230 | AA852431 | Hs. 51299 | NM_021074 *Homo sapiens* NADH de | complex1_24 kD | 14.7 |
| 423801 | NM_015071 | Hs.132942 | GTPase regulator associated WI | RhoGAP, SH3, PH | 14.0 |
| 419639 | AK001502 | Hs. 91753 | hypothetical protein | | 13.6 |
| 419298 | AA853479 | Hs. 89890 | pyruvate carboxylase | CPSase_L_chain, PYC_OADA, H | 43.6 |
| 426108 | AA622037 | Hs. 166468 | programmed cell death 5 | DUF122 | 13.5 |
| 448133 | AA723157 | Hs. 73769 | folate receptor 1 (adult) | Folate_rec | 13.5 |
| 418736 | T18979 | Hs. 87908 | Snf2-related CBP activator pro | helicase_C, AT_hook | 13.5 |
| 436543 | NM_002212 | Hs.5215 | integrin beta 4 binding protei | eIF6 | 13.3 |
| 431515 | NM_012152 | Hs. 258583 | endothetial differentiation, I | 7tm_1 | 13.3 |
| 429469 | M64590 | Hs. 27 | glycine dehydrogenase (decarbo | GDC-P | 13.2 |
| 431462 | AW583672 | Hs. 256311 | granin-like neuroendocrine pep | | 13.2 |
| 444855 | BE409261 | Hs. 12084 | Tu translation elongation fact | GTR_EFTU, GTP_EFTU_D3, GTP_ | 13.2 |
| 423464 | NM_016240 | Hs. 128856 | CSR1 protein | Collagen | 13.1 |
| 450787 | AB006190 | Hs. 25475 | aquaporin 7 | MIP | 13.0 |
| 428539 | AW410063 | Hs. 184877 | solute carrier family 25 (mito | mito_carr | 13.0 |
| 436014 | AF281134 | Hs. 283741 | exosome component Rrp46 | RNaae_PH, RNase_PH_C | 12.9 |
| 416866 | AA297356 | Hs.80324 | serine/threonine protein phosp | Metallophos | 12.9 |
| 433867 | AK000596 | Hs. 3618 | hippocalcin-like 1 | efhand | 12.9 |
| 411408 | U76666 | Hs. 69949 | calcium channel, voltage-depen | ion_trans | 12.8 |
| 432329 | NM_002962 | Hs. 2960 | S100 calcium-binding protein A | S_100, efhand | 12.7 |
| 447887 | AA114050 | Hs.19949 | caspase 8, apoptosis-related c | ICE_p20, DED, ICE_p10 | 12.7 |
| 427448 | BE246449 | Hs. 2157 | Wiskott-Aldrich syndrome (ecze | WH1, PBD, WH2 | 12.7 |
| 428820 | AA436187 | Hs. 172631 | integrin, alpha M (complement | FG-GAP | 12.7 |
| 446603 | NM_014835 | Hs. 15519 | oxysterol-binding protein-rela | Oxysterol_BP | 12.6 |
| 422633 | X56832 | Hs. 118804 | enolase 3, (beta, muscle) | enolase | 12.6 |
| 446839 | BE091926 | Hs.16244 | mitotic spindle coiled-coil re | Troponin | 12.6 |
| 414757 | U46922 | Hs.77252 | fragile histidine triad gene | HIT | 12.5 |
| 428593 | AW207440 | Hs. 185973 | degenerative spermatocyte (hom | | 12.5 |
| 432370 | AA308334 | Hs. 274424 | N-acetylneuraminic acid phosph | Antifreeze, NeuB | 12.5 |
| 401542 | | | C15001413* gi|10645199|ref|NP_ | | 12.4 |
| 428782 | X12830 | Hs.193400 | interleukin 6 receptor | fri3, ig | 12.3 |
| 425999 | AW513051 | Hs. 332981 | ESTs, Weakly similar to I38022 | FAD_binding_2 | 12.3 |
| 422301 | AI752163 | Hs. 114599 | collagen, type VIII, alpha 1 | C1q, Collagen | 12.2 |
| 410720 | AF035154 | Hs. 65756 | regulator of G-protein signall | RGS, G-gamma, DEP | 12.2 |
| 407143 | C14076 | Hs.332329 | EST | | 12.1 |
| 421321 | NM_005309 | Hs. 103502 | glutamic-pyruvate transaminase | aminotran_1_2 | 12.1 |
| 425251 | Z22521 | Hs. 155342 | protein kinase C, delta | pkinase, DAG_PE-bind, pkina | 12.0 |
| 431354 | BE046956 | Hs. 251673 | DNA (cytosine-5-)-methyltransf | PWWP, PHD | 12.0 |
| 420421 | AF281133 | Hs. 343589 | exosome component Rrp41 | RNase_PH, RNase_PH_C | 12.0 |
| 416714 | AF283770 | Hs. 79630 | CD79A antigen (immunoglobulin- | ig, ITAM, Zn_clus | 12.0 |
| 427336 | NM_005658 | Hs. 2134 | TNF receptor-associated factor | MATH | 12.0 |
| 409799 | D11928 | Hs.76845 | phosphoserine phosphatase-like | Hydrolase | 11.9 |
| 436319 | H90727 | Hs. 5123 | inorganic pyrophosphatase | Pyrophosphatase | 11.9 |
| 400748 | | | NM_022122 *Homo sapiens* matrix | | 11.9 |
| 428948 | BE514362 | | FK506-binding protein 3 (25 kD) | FKBP, PIP5K | 11.8 |
| 401215 | | | C12000457* gi|7512178|pir||T30 | trypsin | 11.7 |
| 401281 | | | DKFZP586N2124 protein | | 11.7 |
| 427397 | AI929685 | Hs. 177656 | calmodulin 1 (phosphorylase ki | efhand, RrnaAD | 11.7 |
| 453496 | AA442103 | Hs. 33084 | solute carrier family 2 (facil | sugar_tr | 11.7 |
| 409608 | AF231023 | Hs.55173 | cadherin, EGF LAG seven-pass G | 7tm_2, cadherin, GPS, lamini | 11.7 |
| 424415 | NM_001975 | Hs. 146580 | enolase 2, (gamma, neuronal) | enolase | 11.7 |
| 447495 | AW401864 | Hs. 18720 | programmed cell death 8 (apopt | pyr_redox | 11.6 |
| 426928 | AF037062 | Hs. 172914 | retinol dehydrogenase 5(11-ci | adh_short | 11.6 |
| 405371 | | | NM_005569* *Homo sapiens* LIM do | pkinase, LIM, PDZ | 11.5 |
| 416282 | R86664 | Hs. 167257 | brain link protein-1 | Xlink | 11.4 |
| 452295 | BE379936 | Hs. 28866 | programmed cell death 10 | | 11.4 |
| 430390 | AB023186 | Hs. 241161 | KIAA0969 protein | PH | 11.4 |
| 430594 | AK000790 | Hs. 246885 | hypothetical protein FLJ20783 | PH | 11.2 |
| 443814 | BE281240 | Hs. 9857 | carbonyl reductase | | 11.2 |
| 440242 | AW295871 | | glucose transporter protein 10 | | 11.1 |
| 447365 | BE383676 | Hs. 334 | Rho guanine nucleotide exchang | SH3, PH, RhoGEF | 11.1 |
| 400843 | | | NM_003105*: *Homo sapiens* sortil | ldl_recept_a, fn3, ldl_rece | 11.1 |
| 422418 | AK001383 | Hs. 116385 | hypothetical protein FLJ10521 | RhoGEF | 11.0 |

TABLE 16A-continued

| Pkey | ExAccn | UniGene ID | Unigene Title | Pred. Protein Dom. | R1 |
|---|---|---|---|---|---|
| 400232 | | | NM_001895* Homo sapiens casein | pkinase | 10.9 |
| 426828 | NM_000020 | Hs. 172670 | activin A receptor type II-lik | pkinase, Activin_recp | 10.9 |
| 431157 | AI823969 | Hs. 132678 | ESTs | MAPEG | 10.8 |
| 422616 | BE300330 | Hs. 118725 | selenophosphate synthetase 2 | AIRS, AIRS_C | 10.8 |
| 406779 | AA412048 | Hs. 279574 | CGI-39 protein, cell death-reg | | 10.8 |
| 400389 | AL135841 | | olfactory receptor, family 2, | 7tm_1 | 10.8 |
| 402207 | | | Target Exon | A2M_N, A2M | 10.8 |
| 435615 | Y15065 | Hs. 4975 | potassium voltage-gated channe | ion_trans, KCNQ1_channel | 10.8 |
| 452434 | D30934 | Hs. 29549 | C-type lectin-like receptor-1 | lectin_c | 10.7 |
| 402053 | | | C11001722*: gi\|11436283\|ref\|XP_ | | 10.7 |
| 418641 | BE243136 | Hs. 86947 | a disintegrin and metalloprote | disintegrin, Reprolysin, Pe | 10.6 |
| 431512 | BE270734 | Hs. 2795 | lactate dehydrogenase A | ldh, ldh_C | 10.6 |
| 403213 | | | NM_019595 Homo sapiens interse | SH3, efhand, C2, PH, RhoGEF | 10.6 |
| 412158 | BE241740 | Hs.785 | integrin, alpha 2b (platelet g | FG-GAP, integrin_A | 10.6 |
| 423673 | BE003054 | Hs. 1695 | matrix metalloproteinase 12 (m | Peptidase_M10, hemopexin | 10.6 |
| 403949 | | | C10000813*: gi\|5453992\|ref\|NP_0 | | 10.6 |
| 457670 | AF119666 | Hs. 23449 | insulin receptor tyrosine kina | SH3 | 10.5 |
| 418416 | U11700 | Hs.84999 | ATPase, Cu transporting, beta | E1-E2_ATPase, HMA, Hydrolas | 10.4 |
| 419594 | AA013051 | Hs.91417 | topoisomerase (DNA) II binding | BRCT | 10.4 |
| 422765 | AW409701 | Hs. 1578 | baculoviral IAP repeat-contain | BIR, TK | 10.4 |
| 453023 | AW028733 | Hs. 31439 | serine protease inhibitor, Kun | Kunitz_BPTI | 10.4 |
| 425694 | U51333 | Hs. 159237 | hexokinase 3 (white cell) | hexokinase, hexokinase2 | 10.4 |
| 438800 | AB037108 | Hs.6418 | seven transmembrane domain orp | | 10.3 |
| 402478 | | | Target Exon | Carn_acyltransf | 10.3 |
| 444202 | AL031685 | Hs.12785 | KIAA0939 protein | Na_H_Exchanger, ABC2_membr | 10.3 |
| 425597 | U28694 | Hs. 158324 | chemokine (C-C motif) receptor | 7tm_1 | 10.3 |
| 413431 | AW246428 | Hs.75355 | ubiquitin-conjugating enzyme E | UQ_con | 10.2 |
| 415200 | AL040328 | Hs. 78202 | SWI/SNF related, matrix associ | SNF2_N, helicase_C, bromodo | 10.2 |
| 414874 | D26351 | Hs. 77515 | inositol 1,4,5-triphosphate re | RYDR_ITPR, ion_trans, MIR | 10.2 |
| 423524 | AF055989 | Hs. 129738 | potassium voltage-gated channe | ion_trans, K_tetra, thaumat | 10.2 |
| 457558 | AF083955 | Hs.279852 | G protein-coupled receptor | 7tm_1, globin | 10.2 |
| 445629 | AI245701 | Hs. 193326 | fibroblast growth factor recep | | 10.1 |
| 434314 | BE392921 | Hs. 3797 | RAB26, member RAS oncogene fam | ras, arf | 10.1 |
| 402497 | | | C1001261*: gi\|2695979\|emb\|CAA70 | | 10.1 |
| 449853 | AF006823 | Hs. 24040 | potassium channel, subfamily K | ion_trans | 10.0 |
| 427672 | AA356615 | Hs. 336916 | death-associated protein 6 | | 10.0 |
| 412048 | AW866863 | Hs. 73090 | nuclear factor ot kappa light | RHD, TIG, ank, death | 10.0 |
| 410079 | U94362 | Hs.58589 | glycogenin 2 | Glyco_transf_8 | 10.0 |
| 420319 | AW406289 | Hs. 96593 | hypothetical protein | ras, art | 10.0 |
| 420332 | NM_001756 | Hs. 1305 | serine (or cysteine) proteinas | serpin | 9.9 |
| 405474 | | | NM_001093*: Homo sapiens acetyl | CPSase_L_chain, biotin_lip | 9.9 |
| 401507 | | | C15000810*: gi\|11131272\|sp\|P793 | | 9.9 |
| 431434 | BE267696 | Hs.254105 | enolase 1, (alpha) | enolase | 9.9 |
| 447232 | AW499834 | Hs. 327 | interleukin 10 receptor, alpha | | 9.8 |
| 432343 | NM_002960 | Hs. 2961 | S100 calcium-binding protein A | S_100 | 9.8 |
| 408931 | AA251995 | Hs. 334648 | poly(A) polymerase alpha | NTP_transf_2 | 9.8 |
| 421542 | AA411607 | Hs.118964 | ESTs, Weakly similar to KIAA11 | | 9.8 |
| 430323 | U40714 | Hs. 239307 | tyrosyl-tRNA synthetase | DUF101 | 9.8 |
| 412270 | AC005262 | Hs. 73797 | guanine nucleotide binding pro | G-alpha, arf | 9.7 |
| 424649 | BE242035 | Hs. 151461 | embryonic ectoderm development | WD40 | 9.7 |
| 400772 | | | NM_003105*: Homo sapiens sortil | ldl_recept_a, fn3, ldl_rece | 9.7 |
| 450493 | M93718 | Hs. 166373 | nitric oxide synthase 3 (endot | flavodoxin, FAD_binding, NO | 9.7 |
| 401510 | | | NM_017434 Homo sapiens dual ox | ethand, Ferric_reduct | 9.7 |
| 404596 | | | Target Exon | | 9.7 |
| 451367 | AA923729 | Hs. 26322 | cell cycle related kinase | pkinase | 9.7 |
| 417810 | D28419 | Hs. 82609 | hydroxymethylbilane synthase | Porphobil_deam | 9.6 |
| 432855 | AF017988 | Hs.279565 | secreted frizzled-related prot | Fz, NTR | 9.6 |
| 424263 | M77640 | Hs. 1757 | L1 cell adhesion molecule (hyd | fn3, ig, IRK | 9.6 |
| 430398 | AF105202 | Hs. 241376 | potassium voltage-gated channe | ion_trans, KCNQ1_channel | 9.6 |
| 424339 | BE257148 | | endoglycan | MCM | 9.6 |
| 429257 | AW163799 | Hs. 198365 | 2,3-bisphosphoglycerate mutase | PGAM | 9.6 |
| 407065 | Y10141 | | gb.H. sapiens DAT1 gene, partia | SNF | 9.6 |
| 433938 | AF161536 | Hs. 284292 | ubiquinol-cytochrome c reducta | | 9.6 |
| 409649 | AA159216 | Hs. 55505 | hypothetical protein FLJ20442 | Y_phosphatase, DSPc | 9.6 |
| 404968 | | | C4001170: gi\|6863176\|gb\|AAF3040 | | 9.5 |
| 400833 | | | C11000890: gi\|3746443\|gb\|AAC639 | 7tm_1 | 9.5 |
| 410191 | AI609645 | | NM_021075*: Homo sapiens NADH d | | 9.5 |
| 444633 | AF111713 | Hs. 286218 | junctional adhesion molecule 1 | ig | 9.4 |
| 427747 | AW411425 | Hs. 180655 | serine/threonine kinase 12 | pkinase | 9.4 |
| 415169 | W42913 | Hs. 78089 | ATPase, vacuolar, 14 kD | ATP-synt_F | 9.4 |
| 432579 | AF043244 | Hs. 278439 | nucleolar protein 3 (apoptosis | CARD | 9.4 |
| 422328 | X60459 | Hs. 1513 | interferon (alpha, beta and om | | 9.4 |
| 445143 | U29171 | Hs.75852 | casein kinase 1, delta | pkinase | 9.4 |
| 450883 | NM_001348 | Hs. 25619 | death-associated protein kinas | pkinase | 9.4 |
| 414625 | AA335738 | Hs. 76686 | glutathione peroxidase 1 | GSHPx | 9.3 |
| 401935 | | | Target Exon | PH | 9.3 |
| 418329 | AW247430 | Hs. 84152 | cystathionine-beta-synthase | PALP, CBS | 9.3 |

TABLE 16A-continued

| Pkey | ExAccn | UniGene ID | Unigene Title | Pred. Protein Dom. | R1 |
|---|---|---|---|---|---|
| 425242 | D13635 | Hs. 155287 | KIAA0010 gene product | HECT, IQ | 9.3 |
| 400404 | AF161221 | | kallikrein 14 | trypsin | 9.2 |
| 442332 | AI693251 | Hs.8248 | Target CAT | fer2, molybdopterin, bac_dn | 9.2 |
| 431534 | AL137531 | Hs. 258890 | Homo sapiens mRNA; cDNA DKFZp4 | | 9.2 |
| 402823 | | | C1002456*: gi|9930918|emb|CAC05 | | 9.1 |
| 404527 | | | peptide YY, 2 (seminalplasmin) | GDA1_CD39 | 9.1 |
| 439963 | AW247529 | Hs. 6793 | platelet-activating factor ace | PAF-AH_lb, Lipase_GDSL | 9.1 |
| 412970 | AB026436 | Hs.177534 | dual specificity phosphatase 1 | Rhodanese, DSPc | 9.1 |
| 443553 | AL040535 | Hs. 9573 | ATP-binding cassette, sub-fami | ABC_tran | 9.1 |
| 400933 | | | NM_004347 Homo sapiens caspase | ICE_p20, ICE_p10, CARD | 9.0 |
| 403268 | | | NM_002210*: Homo sapiens integr | FG-GAP | 9.0 |
| 446673 | NM_016361 | Hs. 15871 | LPAP for lysophosphatidic acid | acid_phosphat | 9.0 |
| 422531 | AW967280 | Hs. 293894 | ESTs, Weakly similar to HERC2 | pkinase | 9.0 |
| 421658 | X84048 | Hs.301760 | frequenin (Drosophila) homolog | ethand | 9.0 |
| 401885 | | | Target Exon | kinesin | 9.0 |
| 402651 | | | NM_000721*: Homo sapiens calciu | ion_trans | 9.0 |
| 457432 | NM_005136 | Hs.268538 | potassium voltage-gated channe | ISK_Channel | 9.0 |
| 433146 | AB033002 | Hs. 21413 | solute carrier family 12, (pot | | 9.0 |
| 420090 | AA220238 | Hs. 94986 | ribonuclease P (38 kD) | Ribosomal_L7Ae | 9.0 |
| 425281 | AA444390 | Hs. 155482 | hydroxyacyl glutathione hydrol | lactamase_B | 9.0 |
| 410855 | X97795 | Hs.66718 | RAD54 (S.cerevisiae)-like | SNF2_N, helicase_C | 9.0 |
| 407986 | U32659 | Hs.41724 | interleukin 17 (cytotoxic T-ly | | 9.0 |
| 431131 | N84730 | Hs. 250616 | isocitrate dehydrogenase 3 (NA | isodh | 9.0 |
| 422802 | NM_004278 | Hs.27008 | phosphatidylinositol glycan, c | DUF158 | 9.0 |
| 447958 | AW796524 | Hs.68644 | Homo sapiens microsomal signal | | 9.0 |
| 438080 | AA777381 | Hs. 291530 | ESTs, Weakly similar to ALUC_H | | 9.0 |
| 418843 | AJ251016 | Hs. 89230 | potassium intermediate/small c | CaMBD, SK_channel | 9.0 |
| 419244 | AI436567 | Hs. 89761 | ATP synthase, H transporting, | ATP-synt_DE | 8.9 |
| 404676 | | | Target Exon | | 8.9 |
| 428744 | BE267033 | Hs.192853 | ubiquitin-conjugating enzyme E | UQ_con | 8.9 |
| 421474 | U76362 | Hs. 104637 | solute carrier family 1 (gluta | SDF | 8.9 |
| 419056 | M89957 | Hs. 89575 | CD79B antigen (immunoglobulin- | ig, ITAM | 8.9 |
| 424825 | AF207069 | Hs. 153357 | procollagen-lysine, 2-oxogluta | 2OG-FeII_Oxy, Glycos_trans | 8.9 |
| 444628 | U01120 | Hs. 242 | glucose-6-phosphatase, catalyt | PAP2 | 8.9 |
| 404199 | | | ENSP00000211797*: Helicase SKI2 | RasGAP, PH | 8.9 |
| 428826 | AL048842 | Hs. 194019 | attractin | lectin_c, CUB, Kelch, PSI, EG | 8.9 |
| 410681 | AW246890 | Hs. 65425 | calbiridin 1, (28 kD) | ethanol | 8.8 |
| 415056 | AB004662 | Hs. 77867 | adenosine A1 receptor | 7tm_1 | 8.8 |
| 400471 | | | Target Exon | | 8.8 |
| 406591 | | | NM_003888* Homo sapiens retina | aldedh | 8.8 |
| 425427 | AI652662 | Hs. 157205 | branched chain aminotransferas | aminotran_4 | 8.8 |
| 410839 | NM_006849 | Hs.66581 | protein disulfide isomerase | thiored, Rho_GDI, gntR | 8.7 |
| 430037 | BE409649 | Hs. 227789 | mitogen-activated protein kina | pkinase | 8.7 |
| 450848 | AI677994 | Hs. 428 | fms-related tyrosine kinase 3 | flt3_lig | 8.7 |
| 414534 | BE257293 | Hs. 76366 | BCL2-antagonist of cell death | | 8.7 |
| 401454 | | | NM_014226*: Homo sapiens renal | pkinase | 8.7 |
| 408493 | BE206854 | Hs. 46039 | phosphoglycerate mutase 2 (mus | PGAM | 8.7 |
| 433333 | AI016521 | Hs.71816 | v-akt murine thymoma viral onc | homeobox, pkinase, PH, pkina | 8.7 |
| 430432 | AB037758 | Hs.241419 | KIAA1337 protein | Patched | 8.7 |
| 406128 | | | NM_002920* Homo sapiens regula | Oest_recep, zf-C4, hormone_ | 8.7 |
| 419493 | AF001212 | Hs. 90744 | proteasome (prosome, macropain | PCI | 8.7 |
| 439569 | AW602166 | Hs. 222399 | CEGP1 protein | CUB, EGF | 8.6 |
| 401134 | | | C12001198 gi|3183183|sp|Q92142 | biopterin_H | 8.6 |
| 442286 | W31847 | Hs. 50335 | cytochrome P450 monooxygenase | | 8.6 |
| 428376 | AF119665 | Hs. 184011 | pyrophosphatase (inorganic) | Pyrophosphatase | 8.6 |
| 433494 | AB029396 | | beta-1,3-glucuronyltransferase | Glyco_tranf_43 | 8.6 |
| 427001 | NM_006482 | Hs. 173135 | dual-specificity tyrosine-(Y)- | pkinase | 8.6 |
| 437278 | AA748017 | Hs.290145 | ESTs | cNMP_binding | 8.6 |
| 414463 | T69078 | Hs. 76177 | alpha-1-microglobulin/bikunin | lipocalin, Kunitz_BPTI | 8.6 |
| 421871 | AK001416 | Hs. 306122 | glycoprotein, synaptic 2 | Steroid_dh | 8.6 |
| 447827 | U73727 | Hs. 19718 | protein tyrosine phosphatase, | Y_phosphatase, fn3, ig, MAM | 8.6 |
| 403379 | | | Target Exon | DNA_pol_A | 8.6 |
| 446872 | X97058 | Hs.16362 | pynmidinergic receptor P2Y, G | 7tm_1 | 8.6 |
| 432857 | NM_016103 | Hs. 279582 | GTP-binding protein Sara | arf, ras | 8.5 |
| 420970 | AA305079 | Hs. 1342 | cytochrome c oxidase subunit V | COX5B | 8.5 |
| 427221 | L15409 | Hs. 174007 | von Hippel-Lindau syndrome | VHL | 8.5 |
| 402209 | | | Target Exon | A2M_N, A2M | 8.5 |
| 400518 | | | C10002057* gi|3211705|gb|AAC21 | | 8.5 |
| 425606 | U52112 | Hs. 158331 | renin-binding protein | | 8.5 |
| 437965 | AA843222 | Hs. 193534 | ESTs, Moderately similar to AL | RasGEF | 8.5 |
| 433392 | AF038535 | Hs. 127588 | synaptotagmin VII | C2 | 8.5 |
| 402191 | | | NM_021733* Homo sapiens testis | | 8.5 |
| 458963 | AI701393 | Hs. 278728 | Rad and Gem-related 2 (rat hom | ras | 8.5 |
| 431857 | W19144 | Hs. 271742 | ADP-ribosyltransferase (NAD, p | PARP, PARP_reg | 8.5 |
| 457579 | AB030816 | Hs.36761 | HRAS-like suppressor | | 8.5 |
| 409656 | NM_005133 | Hs. 288626 | RCE1, prenyl protein protease | Abi | 8.5 |
| 456373 | BE247706 | Hs. 89751 | membrane-spanning 4-domains, s | | 8.4 |

TABLE 16A-continued

| Pkey | ExAccn | UniGene ID | Unigene Title | Pred. Protein Dom. | R1 |
|---|---|---|---|---|---|
| 432499 | BE276633 | | RAB6B, member RAS oncogene fam | ras, arf | 8.4 |
| 400565 | | | Target Exon | | 8.4 |
| 401960 | | | Target Exon | Branch | 8.3 |
| 432545 | X52486 | Hs. 3041 | uracil-DNA glycosylase 2 | cyclin | 8.3 |
| 445303 | AW362198 | Hs. 12503 | interleukin 15 receptor, alpha | sushi | 8.3 |
| 404528 | | | peptide YY, 2 (seminalplasmin) | GDA1_CD39 | 8.3 |
| 428542 | D79989 | | KIAA0167 gene product | ank, PH, ArfGap, ras | 8.3 |
| 406868 | AA505445 | Hs. 300697 | immunoglobulin heavy constant | | 8.3 |
| 405473 | | | NM_001093* Homo sapiens acetyl | CPSase_L_chain, biotin_lip | 8.3 |
| 408601 | U47928 | Hs. 86122 | protein A | 7tm_1 | 8.3 |
| 415008 | NM_002777 | Hs.928 | proteinase 3 (serine proteinas | trypsin | 8.3 |
| 430258 | AU076644 | Hs. 236963 | protein phosphatase 2A, regula | | 8.3 |
| 436483 | AJ272063 | Hs. 283010 | vanilloid receptor subtype 1 | ank, ion_trans | 8.3 |
| 459302 | NM_002314 | Hs. 36566 | LIM domain kinase 1 | | 8.3 |
| 437644 | AA748575 | Hs.136748 | lectin-like NK cell receptor | lectin_c | 8.3 |
| 421707 | NM_014921 | Hs.107054 | lectomedin-2 | Latrophilin, OLF, 7tm_2, Gal | 8.2 |
| 414629 | AA345824 | Hs. 76688 | carboxylesterase 1 (monocyte/m | COesterase | 8.2 |
| 453898 | AW003512 | Hs. 232770 | arachidonate lipoxygenase 3 | | 8.2 |
| 424053 | AF057036 | Hs.138520 | collagen-like tail subunit (si | Collagen | 8.2 |
| 457398 | BE258532 | Hs. 251871 | CTP synthase | GATase | 8.2 |
| 421504 | AW402997 | Hs. 105052 | adaptor protein with pleckstn | SH2, PH | 8.1 |
| 406495 | | | Target Exon | SRCR | 8.1 |
| 453610 | AW368882 | Hs. 33818 | RecQ protein-like 5 | DEAD, helicase_C | 8.1 |
| 424880 | NM_000328 | Hs. 153614 | retinitis pigmentosa GTPase re | RCC1 | 8.1 |
| 423847 | U16997 | Hs. 133314 | RAR-related orphan receptor C | hormone_rec, zf-C4 | 8.1 |
| 409829 | M33552 | Hs.56729 | lymphocyte-specific protein 1 | Caldesmon | 8.1 |
| 401180 | | | eukaryotic translation elongat | ion_trans, IQ | 8.1 |
| 452072 | BE258857 | Hs. 27744 | RAB3A, member RAS oncogene fam | ras, arf | 8.1 |
| 426484 | AA379658 | Hs. 272759 | KIAA1457 protein | IP_trans | 8.1 |
| 402453 | | | C1002496 gi|7363439|ref|NP_039 | 7tm_1 | 8.1 |
| 457310 | W28363 | Hs.239752 | nuclear receptor subfamily 2, | | 8.1 |
| 422069 | AJ010063 | Hs. 343603 | titin-cap (telethonin) | globin, cNMP_binding, pkina | 8.1 |
| 400275 | | | NM_006513* Homo sapiens seryl- | NA | 8.0 |
| 434357 | AW732284 | Hs. 3828 | mevalonate (diphospho) decarbo | GHMP_kinases | 8.0 |
| 430299 | W28673 | Hs. 106747 | senne carboxypeptidase 1 prec | | 8.0 |
| 413762 | AW411479 | Hs. 848 | FK06-binding protein 4 (59 kD) | FKBP, TPR | 8.0 |
| 402393 | | | ENSP00000085284* CDNA FLJ20404 | RhoGEF, PH | 8.0 |
| 429252 | NM_004658 | Hs. 198312 | RAS protein activator like 1 ( | C2, PH, RasGAP, BTK | 8.0 |
| 456181 | L36463 | Hs. 1030 | ras inhibitor | RA, SH2, VPS9 | 7.9 |
| 431493 | AI791493 | Hs.129873 | ESTs, novel cytochrome P450 | p450 | 7.9 |
| 451558 | NM_001089 | Hs. 26630 | ATP-binding cassette, sub-fami | ABC_tran, SRP54 | 7.8 |
| 415758 | BE270465 | Hs. 78793 | protein kinase C, zeta | pkinase, DAG_PE-bind, pkina | 7.8 |
| 419270 | NM_005232 | Hs. 89839 | EphA1 | EPH_lbd, pkinase, SAM, fn3 | 7.8 |
| 422837 | U25441 | Hs. 121478 | dopamine receptor D3 | 7tm_1 | 7.8 |
| 401118 | | | Target Exon | pkinase | 7.8 |
| 426440 | BE382756 | Hs. 169902 | solute carrier family 2 (facil | sugar_tr | 7.8 |
| 418635 | L11329 | Hs. 1183 | dual specificity phosphatase 2 | DSPc, Rhodanese, Y_phosphat | 7.8 |
| 432747 | NM_014404 | Hs. 278907 | calcium channel, voltage-depen | PMP22_Claudin | 7.8 |
| 403672 | | | C4001244 gi|539933|pir|A61275 | tubulin | 7.8 |
| 437806 | AI424921 | Hs.122487 | ESTs, Weakly similar to A54854 | RasGAP | 7.7 |
| 456890 | U48213 | Hs. 155402 | D site of albumin promoter (al | DAGKc, bZIP | 7.7 |
| 424107 | AB014606 | Hs. 139648 | kinesin family member 1C | kinesin, FHA | 7.7 |
| 452695 | AW780199 | Hs. 30327 | mitogen-activated protein kina | | 7.7 |
| 433262 | AI571225 | Hs. 284171 | KIAA1535 protein | cNMP_binding, ion_trans | 7.7 |
| 424198 | AB029010 | Hs. 143026 | KIAA1087 protein | Na_Ca_Ex, Calx-beta | 7.6 |
| 406496 | | | Target Exon | SRCR | 7.6 |
| 425423 | NM_005897 | Hs.157180 | intracisternal A particle-prom | BTB, Kelch | 7.6 |
| 402211 | | | KIAA0430 gene product | ion_trans, K_tetra | 7.6 |
| 408710 | Y10256 | Hs.47007 | mitogen-activated protein kina | pkinase, SAM_decarbox | 7.5 |
| 457615 | W56321 | Hs. 111460 | calcium/calmodulin-dependent p | pkinase | 7.5 |
| 402760 | | | NM021797* Homo sapiens eosino | Glyco_hydro_18, CBM_14 | 7.5 |
| 425428 | AL110261 | Hs. 157211 | DKFZP586B0621 protein | C1q, Collagen | 7.4 |
| 423579 | NM_004121 | Hs. 1675 | gamma-glutamyltransferase-like | G_glu_transpept | 7.4 |
| 413104 | L42374 | Hs.75199 | protein phosphatase 2, regulat | B56 | 7.4 |
| 419660 | BE280337 | Hs.194693 | solute carrier family 7 (catio | aa_permeases | 7.4 |
| 424774 | BE244179 | Hs.153022 | TATA box binding protein (TBP) | | 7.4 |
| 402632 | | | Target Exon | Fz, knngle, ig | 7.4 |
| 444159 | AF116846 | Hs. 10431 | dead nnger (Drosophila)-like | ARID, SNF | 7.4 |
| 405714 | | | ENSP00000221137: Olfactory rece | 7tm_1 | 7.3 |
| 442732 | AA257161 | Hs. 8658 | hypothetical protein DKFZp434E | EGF, laminin_EGF, Xlink, S_m | 7.3 |
| 421758 | BE397336 | Hs. 1422 | Gardner-Rasheed feline sarcoma | SH2, SH3, pkinase | 7.3 |
| 415995 | NM_004573 | | phospholipase C, beta 2 | PI-PLC-X, PI-PLC-Y, C2 | 7.3 |
| 405137 | | | Target Exon | | 7.3 |
| 402460 | | | C1001261* gi|2695979|emb|CAA70 | | 7.3 |
| 431398 | BE616547 | Hs. 2785 | keratin 17 | filament | 7.3 |
| 429592 | AB029041 | Hs. 209646 | KIAA1118 protein | Troponin | 7.3 |
| 429225 | BE250337 | Hs. 198273 | Target CAT | | 7.2 |

TABLE 16A-continued

| Pkey | ExAccn | UniGene ID | Unigene Title | Pred. Protein Dom. | R1 |
|---|---|---|---|---|---|
| 423015 | U18548 | Hs. 123034 | G protein-coupled receptor 12 | | 7.2 |
| 454373 | NM_005133 | Hs.288626 | RCE1, prenyl protein protease | Abi | 7.2 |
| 440188 | AK001812 | Hs.7036 | N-Acetylglucosamine kinase | ROK | 7.2 |
| 432920 | U37689 | Hs. 3128 | polymerase (RNA) II (DNA direc | | 7.2 |
| 446143 | BE245342 | Hs. 306079 | sec61 homolog | secY | 7.2 |
| 422201 | NM_001505 | Hs.113207 | G protein-coupled receptor 30 | 7tm_1 | 7.2 |
| 440869 | NM_014297 | Hs.7486 | protein expressed in thyroid | lactamase_B | 7.1 |
| 435099 | AC004770 | Hs. 4756 | flap structure-specific endonu | XPG_N, XPG_I, 5_3_exonuclea | 7.1 |
| 437161 | AA054477 | Hs. 25391 | ESTs | | 7.1 |
| 429683 | AF148213 | Hs.211604 | adisintegrin-like and metallo | tsp_1, Reprolysin, Pep_M12B | 7.1 |
| 426268 | AF083420 | Hs. 168913 | serine/threonine kinase 24 (St | pkinase | 7.1 |
| 445087 | AW893449 | Hs. 12303 | suppreosor of Ty (*S. cerevisiae* | S1, SH2, Ribosomal_L23, pkin | 7.1 |
| 416377 | AA179930 | Hs. 293867 | caspase recruitment domain pro | | 7.1 |
| 421748 | NM_014718 | Hs.107809 | KIAA0726 gene product | cadherin | 7.1 |
| 426691 | NM_006201 | Hs. 171834 | PCTAIRE protein kinase 1 | pkinase | 7.0 |
| 428599 | AB033078 | Hs. 186613 | sphingosine-1-phosphate lyase | pyndoxal_deC | 7.0 |
| 411898 | BE409714 | Hs. 44856 | hypothetical protein FLJ12116 | | 7.0 |
| 427010 | AW138332 | | muscle RAS oncogene homolog | ras | 7.0 |
| 457305 | BE268048 | Hs. 236494 | RAB10, member RAS oncogene fam | ras, arf | 7.0 |
| 431630 | NM_002204 | Hs. 265829 | integrin, alpha 3 (antigen CD4 | integrin_A, FG-GAP, Rhabd_g | 7.0 |
| 457764 | AW028284 | Hs. 4815 | nudix (nucleoside diphosphate | NUDIX | 6.9 |
| 435575 | AF213457 | Hs. 44234 | triggering receptor expressed | ig | 6.9 |
| 456488 | AW015098 | Hs. 301946 | ESTs, Weakly similar to T30867 | | 6.9 |
| 428761 | AF236119 | Hs. 193076 | GRB2-related adaptor protein 2 | SH2,SH3 | 6.9 |
| 430396 | D49742 | Hs. 241363 | hyaluronan-binding protein 2 | trypsin, knngle, EGF | 6.9 |
| 422066 | AW249275 | Hs. 343521 | malate dehydrogenase 2, NAD (m | ldh, ldh_C, adh_short, Semia | 6.9 |
| 445937 | AI452943 | Hs. 321231 | UDP-Gal betaGlcNAc beta 1,4-g | Galactosyl_T_2 | 6.9 |
| 457499 | AA953015 | Hs. 274370 | hypothetical protein FLJ20260 | PH | 6.8 |
| 400845 | | | NM_003105*: *Homo sapiens* sortil | ldl_recept_a, fn3, ldl_rece | 6.8 |
| 416931 | D45371 | Hs.80485 | adipose most abundant gene tra | C1q, Collagen | 6.8 |
| 414915 | NM_002462 | Hs.76391 | myxovirus (influenza) resistan | dynamin_2, dynamin, GED | 6.8 |
| 432990 | AL036071 | Hs. 279899 | tumor necrosis factor receptor | TNFR_c6 | 6.8 |
| 458128 | W32474 | Hs.301746 | RAP2A, member of RAS oncogene | ras, arf, ldh | 6.8 |
| 429542 | AF038660 | Hs. 206713 | UDP-Gal: betaGlcNAc beta 1,4-g | Galactosyl_T_2, ig | 6.8 |
| 401488 | | | Target Exon | Glyco_hydro_1 | 6.7 |
| 456243 | AI345001 | Hs. 82380 | menage a trois 1 (CAK assembly | zf-C3HC4 | 6.7 |
| 424321 | W74048 | Hs.1765 | lymphocyte-specific protein ty | SH2, SH3, pkinase | 6.7 |
| 405187 | | | NM_014272. *Homo sapiens* a disin | Reprolysin, tsp_1, Pep_M12B | 6.7 |
| 413055 | AV655701 | Hs. 75183 | cytochrome P450, subfamily IIE | p450 | 6.7 |
| 448496 | BE379077 | Hs. 130849 | ESTs, Weakly similar to I38022 | NADHdh_2 | 6.7 |
| 419667 | AU077005 | Hs. 92208 | a disintegrin and metalloprote | disintegrin, Reprolysin, Pe | 6.7 |
| 417103 | Z33905 | Hs.81218 | hypothetical protein MGC3597 | TPR, zf-C3HC4, PHD | 6.7 |
| 407687 | AK002011 | Hs.37558 | hypothetical protein FLJ11149 | FAD_Synth | 6.7 |
| 456469 | NM_005109 | Hs. 95220 | oxidative-stress responsive 1 | zf-C2H2, pkinase | 6.7 |
| 449546 | W86248 | Hs. 58819 | ESTs | hexokinase | 6.6 |
| 428926 | NM_001702 | Hs. 194654 | brain-specific angiogenesis in | 7tm_2, tsp_1, GPS, HRM | 6.6 |
| 404953 | | | C1002000* gi|12735712|ref|XP_0 | | 6.6 |
| 449401 | AL135401 | Hs.23557 | serologically defined colon ca | pro_isomerase | 6.6 |
| 429962 | M69113 | Hs. 226795 | glutathione S-transferase pi | GST_C, GST_N | 6.6 |
| 421547 | AA489908 | Hs. 1390 | proteasome (prosome, macropain | Clathrin_lg_ch, proteasome | 6.6 |
| 430035 | NM_003463 | Hs. 227777 | protein tyrosine phosphatase t | Y_phosphatase, DSPc | 6.6 |
| 406867 | AA157857 | Hs.182265 | keratin 19 | filament, bZIP | 6.6 |
| 404946 | | | Target Exon | 3Beta_HSD | 6.5 |
| 435213 | AA092510 | Hs. 5985 | non-kinase Cdc42 effector prot | | 6.5 |
| 411201 | T74588 | Hs. 8509 | ESTs, Weakly similar to C3HU c | A2M_N, A2M | 6.5 |
| 419344 | U94905 | Hs. 277445 | diacylglycerol kinase, zeta (1 | ank, DAGKa, DAGKc, DAG_PE-bi | 6.5 |
| 426194 | T50872 | Hs. 2001 | thromboxane A synthase 1 (plat | p450 | 6.5 |
| 424681 | AA054400 | Hs.151706 | KIAA0134 gene product | helicase_C, PRK | 6.5 |
| 417903 | NM_002342 | Hs.1116 | lymphotoxin beta receptor (TNF | TNFR_c6 | 6.5 |
| 408905 | AV655783 | Hs. 661 | Target CAT | | 6.5 |
| 438646 | AI973076 | Hs. 231958 | matrix metalloproteinase 28 | | 6.5 |
| 431530 | X61615 | Hs. 2798 | leukemia inhibitory factor rec | fn3 | 6.5 |
| 428883 | AA436959 | Hs. 258802 | ATPase, (Na)/K transporting, b | Na_K-ATPase | 6.5 |
| 404757 | | | Target Exon | | 6.4 |
| 406370 | | | interleukin 11 | trypsin | 6.4 |
| 443611 | NM_014397 | Hs. 9625 | NIMA (never in mitosis gene a) | pkinase | 6.4 |
| 424008 | R02740 | Hs. 137555 | putative chemokine receptor; G | 7tm_1 | 6.4 |
| 444912 | AW247380 | Hs. 12124 | putative prostate cancer susce | lactamase_B | 6.4 |
| 454460 | X66945 | Hs. 748 | fibroblast growth factor recep | ig, pkinase | 6.4 |
| 432269 | NM_002447 | Hs. 2942 | macrophage stimulating 1 recep | pkinase, Sema, PSI, TIG, A4_E | 6.4 |
| 458718 | AI359476 | Hs. 157699 | ESTs | | 6.4 |
| 405282 | | | Target Exon | Cache | 6.4 |
| 447245 | AK001713 | Hs. 17860 | hypothetical protein FLJ10851 | E1_dehydrog | 6.3 |
| 442297 | NM_006202 | Hs. 89901 | phosphodiesterase 4A, cAMP-spe | PDEase | 6.3 |
| 400894 | | | C11000129 gi|9938014|ref|NP_06 | 7tm_1 | 6.3 |
| 440446 | NM_013385 | Hs. 7189 | pleckstrin homology, Sec7 and | PH, Sec7 | 6.3 |
| 430886 | L36149 | Hs. 248116 | chemokine (C motif) XC recepto | 7tm_1 | 6.3 |

TABLE 16A-continued

| Pkey | ExAccn | UniGene ID | Unigene Title | Pred. Protein Dom. | R1 |
| --- | --- | --- | --- | --- | --- |
| 451394 | NM_003595 | Hs.26350 | tyrosylprotein sulfotransferas | Sulfotransfer | 6.3 |
| 436523 | BE612990 | Hs. 5212 | single-strand selective monofu | | 6.3 |
| 422714 | AB018335 | Hs. 119387 | KIAA0792 gene product | DUF221 | 6.3 |
| 408924 | AW295606 | Hs. 236131 | homeodomain-interacting protei | | 6.3 |
| 414551 | AI815639 | Hs.76394 | enoyl Coenzyme A hydratase, sh | ECH, Peptidase_U7 | 6.3 |
| 413254 | U40272 | Hs. 75253 | isocitrate dehydrogenase 3 (NA | isodh | 6.3 |
| 415010 | NM_004203 | Hs. 77783 | membrane-associated tyrosine- | pkinase | 6.3 |
| 449761 | AB009698 | Hs. 23965 | solute carrier family 22 (orga | sugar_tr | 6.3 |
| 432221 | M21191 | Hs. 273415 | aldolase A, fructose-bisphosph | glycolytic_enzy, Adeno_E3_ | 6.3 |
| 414513 | AW239400 | Hs.76297 | G protein-coupled receptor kin | pkinase, RGS, pkinase_C | 6.2 |
| 458516 | BE010749 | Hs. 255097 | ESTs | | 6.2 |
| 417985 | AA187545 | Hs. 83114 | crystallin, zeta (quinone redu | adh_zinc | 6.2 |
| 447507 | H59696 | Hs. 18747 | POP7 (processing of precursor, | | 6.2 |
| 418322 | AA284166 | Hs. 84113 | cyclin-dependent kinase inhibi | Y_phosphatase, DSPc | 6.2 |
| 428443 | BE618106 | Hs. 184326 | CDC10 (cell division cycle 10, | GTP_CDC, M | 6.2 |
| 423229 | AC003965 | Hs. 125532 | protease, serine, 26 | trypsin | 6.2 |
| 408903 | BE244377 | Hs.48876 | farnesyl-diphosphate farnesylt | SQS_PSY, dsrm, z-alpha | 6.2 |
| 426176 | AB000462 | Hs. 167679 | SH3-domain binding protein 2 | PH, SH2 | 6.1 |
| 421395 | D90084 | Hs. 1023 | pyruvate dehydrogenase (lipoam | E1_dehydrog | 6.1 |
| 430517 | S80071 | Hs. 241597 | solute carrier family 6 (neuro | SNF | 6.1 |
| 435906 | AI686379 | Hs. 110796 | SAR1 protein | arf, ras | 6.1 |
| 402758 | | | C1001899*: gi|12722636|ref|XP_0 | Glyco_hydro_18 | 6.1 |
| 434202 | BE382411 | Hs. 3764 | guanylate kinase 1 | Guanylate_kin, CoaE, Viral_ | 6.1 |
| 402115 | | | NM_021624 Homo sapiens histami | 7tm_1 | 6.1 |
| 407601 | AC002300 | Hs.37129 | sodium channel, nonvoltage-gat | ASC | 6.1 |
| 404679 | | | Target Exon | | 6.0 |
| 450739 | AI732707 | | ESTs, Weakly similar to ALU7_H | V1R | 6.0 |
| 439888 | AB040949 | Hs. 6733 | pancreas-enriched phospholipas | C2, PI-PLC-Y, PI-PLC-X, RasG | 6.0 |
| 415742 | BE410243 | Hs.78769 | thimet oligopeptidase 1 | Peptidase_M3 | 6.0 |
| 453190 | AB002354 | Hs. 32312 | KIAA0356 gene product | PH, PHD, RUN | 6.0 |
| 439975 | AW328081 | Hs. 6817 | inosine triphosphatase (nucleo | Ham1p_like | 6.0 |
| 412800 | AW950852 | Hs. 74598 | polymerase (DNA directed), del | homeobox | 6.0 |
| 432805 | X94630 | Hs. 3107 | CD97 antigen | 7tm_2, GPS, EGF | 6.0 |
| 418964 | T74640 | | gb: yc57c12 r1 Stratagene liver | A2M_N, A2M | 6.0 |
| 417483 | BE549343 | Hs.82208 | acyl-Coenzyme A dehydrogenase, | Acyl-CoA_dh, Acyl-CoA_dh_M | 6.0 |
| 419755 | H18444 | Hs.134846 | BAI1-associated protein 3 | C2 | 6.0 |
| 457276 | AF235097 | Hs.227583 | Homo sapiens chromosome X map | | 6.0 |
| 423908 | AJ006422 | Hs. 135183 | centaurin-alpha | PH, ArfGap | 6.0 |
| 432118 | N98718 | | gb yy65g02 r1 Soares_multiple_ | | 5.9 |
| 427334 | R44789 | Hs. 33191 | Homo sapiens, Similar to trans | | 5.9 |
| 424959 | NM_005781 | Hs. 153937 | activated p21cdc42Hs. kinase | pkinase, SH3 | 5.9 |
| 453082 | H18835 | Hs. 31608 | hypothetical protein FLJ20041 | ion_trans | 5.9 |
| 421168 | AF182277 | Hs.330780 | cytochrome P450, subfamily IIB | p450 | 5.9 |
| 422287 | F16365 | Hs. 114346 | cytochrome c oxidase subunit V | COX7a, Phage_G | 5.9 |
| 401736 | | | C16000492* gi|3127193|gb|AAD05 | AMP-binding | 5.9 |
| 434755 | AA648502 | | ESTs | | 5.9 |
| 414962 | AF273304 | Hs. 235376 | XPMC2 protein | Exonuclease | 5.8 |
| 407338 | AA773213 | | gb ab66f10 s1 Stratagene lung | ig | 5.8 |
| 448426 | BE018315 | Hs. 280776 | tankyrase, TRF1-interacting an | | 5.8 |
| 409686 | AK000002 | Hs.55879 | Homo sapiens mRNA, cDNA DKFZp4 | ABC_tran | 5.8 |
| 450778 | U81375 | Hs. 25450 | solute carrier family 29 (nucl | Nucleoside_tran | 5.8 |
| 423612 | NM_002067 | Hs. 1686 | guanine nucleotide binding pro | G-alpha, arf | 5.8 |
| 430845 | AF024690 | Hs. 248056 | G protein-coupled receptor 43 | 7tm_1 | 5.8 |
| 424741 | AF051941 | Hs. 343824 | nucleoside diphosphate kinase | NDK | 5.8 |
| 412958 | BE391579 | Hs.75087 | Fas-activafed serine/threonine | | 5.8 |
| 415701 | NM_003878 | Hs. 78619 | gamma-glutamyl hydrolase (conj | GATase | 5.8 |
| 423158 | H97991 | Hs. 193313 | Target CAT | MoaA_NifB_PqqE | 5.8 |
| 414788 | X78342 | Hs. 77313 | cyclin-dependent kinase (CDC2- | pkinase | 5.8 |
| 412915 | AW087727 | Hs. 74823 | NM_004541. Homo sapiens NADH de | | 5.7 |
| 420964 | AL035964 | Hs.100221 | nuclear receptor subfamily 1, | hormone rec, zf-C4 | 5.7 |
| 415503 | U36601 | Hs.78473 | N-deacetylase/N-sulfotransfera | Sulfotransfer | 5.7 |
| 433074 | AL045019 | Hs. 323462 | Homo sapiens cDNA FLJ11214 fis | DEAD, helicase_C, dsrm, Vira | 5.7 |
| 409124 | AW292809 | Hs. 50727 | N-acetylglucosaminidase, alpha | | 5.7 |
| 428270 | BE501549 | Hs. 107040 | ESTs | | 5.7 |
| 435114 | AA775483 | Hs.288936 | mitochondrial ribosomal protei | ODC_AZ | 5.7 |
| 425211 | M18667 | Hs. 1867 | progastricsin (pepsinogen C) | asp | 5.7 |
| 453054 | AI878908 | Hs. 31547 | Target CAT | | 5.7 |
| 420730 | NM_002691 | Hs. 99890 | polymerase (DNA directed), del | ICL | 5.7 |
| 415117 | AF120499 | Hs. 78016 | polynucleotide kinase 3'-phosp | Viral_helicase 1 | 5.7 |
| 400985 | | | Target Exon | | 5.7 |
| 413163 | Y00815 | Hs.75216 | protein tyrosine phosphatase, | fn3, ig, Y_phosphatase | 5.7 |
| 413586 | NM_001610 | Hs. 75589 | acid phosphatase 2, lysosomal | acid_phosphat | 5.7 |
| 457308 | AI416988 | Hs. 238272 | inositol 1,4,5-triphosphate re | ion_trans, RYDR_ITPR, MIR | 5.7 |
| 400551 | | | C10001991*.gi|6624920|emb|CAB6 | SRCR | 5.7 |
| 433472 | AI541246 | Hs. 3343 | phosphoglycerate dehydrogenase | 2-Hacid_DH, 2-Hacid_DH_C, M | 5.7 |
| 409531 | BE384319 | Hs. 54702 | xylosylprotein beta1,4-galacto | Galactosyl_T_2 | 5.7 |
| 449139 | BE268315 | Hs. 23111 | phenylalanine-tRNA synthetase- | neur | 5.7 |

TABLE 16A-continued

| Pkey | ExAccn | UniGene ID | Unigene Title | Pred. Protein Dom. | R1 |
|---|---|---|---|---|---|
| 450207 | T87615 | Hs. 14716 | ESTs | | 5.7 |
| 400266 | | | NM_002858* Homo sapiens ATP-bi | ABC_tran | 5.6 |
| 430713 | AA351647 | Hs.2642 | eukaryotic translation elongat | GTP_EFTU, GTP_EFTU_D3, GTP_ | 5.6 |
| 420911 | U77413 | Hs. 100293 | O-linked N-acetylglucosamine ( | TPR | 5.6 |
| 405683 | | | Target Exon | | 5.6 |
| 449181 | X96783 | Hs. 23179 | synaptotagmin V | C2 | 5.6 |
| 414457 | AW514320 | Hs. 76159 | ATPase, H transporting, lysoso | ATP-synt_C | 5.6 |
| 415193 | AL048891 | Hs. 12185 | hypothetical protein MGC14333 | | 5.6 |
| 434883 | AW381538 | Hs.19807 | hypothetical protein MGC12959 | | 5.6 |
| 433135 | AA443873 | Hs. 110477 | dolichyl-phosphate mannosyltra | | 5.6 |
| 413049 | NM_002151 | Hs. 823 | hepsin (tranamembrane protease | trypsin | 5.6 |
| 420899 | NM_001629 | Hs. 100194 | arachidonate 5-lipoxygenase-ac | MAPEG | 5.6 |
| 423397 | NM_001838 | Hs.1652 | chemokine (C-C motif) receptor | 7tm_1 | 5.5 |
| 443759 | BE390832 | Hs. 134729 | FXYD domain-containing ion ha | | 5.5 |
| 454112 | NM_000885 | Hs. 40034 | integrin, alpha 4 (antigen CD4 | integrin_A, FG-GAP | 5.5 |
| 405594 | | | NM_021949 Homo sapiens ATPase | E1-E2_ATPase, Hydrolase | 5.5 |
| 416322 | BE019494 | Hs. 79217 | pyrroline-5-carboxylate reduct | P5CR, Octopine_DH_N | 5.5 |
| 446755 | AW451473 | Hs. 16134 | serine/threonine kinase 10 | pkinase, TYA | 5.5 |
| 411030 | BE387193 | Hs. 67896 | 7-60 protein | | 5.5 |
| 431498 | AK001777 | Hs. 258551 | aspartyl aminopeptidase | Peptidase_M18 | 5.5 |
| 433012 | NM_004045 | Hs. 279910 | ATX1 (antioxidant protein 1, y | HMA | 5.5 |
| 414907 | X90725 | Hs.77597 | polo (Drosophia)-like kinase | pkinase, POLO_box | 5.5 |
| 424572 | M19650 | Hs. 92909 | 2',3'-cyclic nucleotide 3'pho | | 5.5 |
| 406617 | | | Target Exon | efhand, Ferric_reduct | 5.5 |
| 421883 | X55079 | Hs. 1437 | glucosidase, alpha, acid (Pomp | trefoil, Glyco_hydro_31 | 5.4 |
| 419525 | T79257 | Hs. 1259 | asialoglycoprotein receptor 2 | lectin_c | 5.4 |
| 448093 | AW977382 | Hs. 15898 | 2,4-dienoyl CoA reductase 2, p | adh_short | 5.4 |
| 411574 | BE242842 | Hs. 6780 | protein tyrosine kisase 9-like | cofilin_ADF | 5.4 |
| 406432 | | | CD1E antigen, e polypeptide | Sulfotransfer | 5.4 |
| 428921 | Z43809 | Hs.194638 | polymerase (RNA) II (DNA direc | | 5.4 |
| 430337 | M36707 | Hs. 239600 | calmodulin-like 3 | efhand | 5.4 |
| 427162 | AB011133 | Hs. 173864 | KIAA0561 protein | pkinase, PDZ | 5.4 |
| 414216 | D86970 | Hs. 75822 | TGFB1-induced anti-apoptotic f | oxidored_q4, myosin_head, b | 5.4 |
| 422083 | NM_001141 | Hs. 111256 | arachidonate 15-lipoxygenase, | lipoxygenase, PLAT | 5.4 |
| 424373 | AJ133798 | Hs. 146219 | copine VII | C2 | 5.4 |
| 449405 | AA001350 | | gb zh83h05 r1 Soares_fetal_liv | mito_carr | 5.4 |
| 409983 | D50922 | Hs.57729 | Kelch-like ECH-associated prot | BTB, Kelch | 5.4 |
| 455818 | AI733747 | Hs. 71174 | interleukin 21 receptor | | 5.4 |
| 424357 | AW961058 | Hs. 44856 | hypothetical protein FLJ12116 | | 5.4 |
| 423606 | AB011094 | Hs.129892 | KIAA0522 protein | PH, bZIP, IQ, Sec7 | 5.3 |
| 432311 | BE083080 | Hs.274323 | similar to sialyltransferase 7 | Glyco_transf_29 | 5.3 |
| 450080 | AB037831 | Hs. 24372 | ESTs, Weakly similar to dJ207H | DEAD, GSPII_E | 5.3 |
| 423778 | Y09267 | Hs.132821 | flavin containing monooxygenas | FMO-like, pyr_redox | 5.3 |
| 402338 | | | Target Exon | p450 | 5.3 |
| 412276 | BE262621 | Hs. 73798 | macrophage migration inhibitor | MIF | 5.3 |
| 437967 | BE277414 | Hs.5947 | mel transforming oncogene (der | ras, art | 5.3 |
| 424766 | BE388855 | Hs.152978 | proteaseome (prosome, macropar | PA28_alpha, PA28_beta | 5.3 |
| 447766 | NM_016011 | Hs. 19513 | CGI-63 protein | adh_zinc | 5.3 |
| 453660 | X98507 | Hs. 286226 | myosin IC | myosin_head, IQ | 5.2 |
| 435327 | BE301871 | Hs. 4867 | mannosyl (alpha-1,3-)-glycopro | HLH, Myc_N_term, Myc-LZ | 5.2 |
| 432336 | NM_002759 | Hs. 274382 | protein kinase, interferon-ind | dsrm, pkinase | 5.2 |
| 445139 | AB037848 | Hs. 12365 | synaptotagmin XIII | C2 | 5.2 |
| 429214 | AB012722 | Hs. 198256 | kinesin-like 3 | kinesin | 5.2 |
| 432462 | AK000013 | Hs.274701 | thymidine kinase 2, mitochondr | dNK | 5.2 |
| 424387 | AI739312 | Hs. 284163 | ANKHZN protein | | 5.2 |
| 405697 | | | gb Human homeobox-like mRNA | | 5.2 |
| 450321 | Y16521 | Hs. 24812 | CDP-diacylglycerol synthase (p | Cytidylyltrans, Adeno_VII | 5.1 |
| 412939 | AW411491 | Hs.75069 | eukaryotic translation elongat | SHMT | 5.1 |
| 445109 | AF039916 | Hs. 12330 | ectonucleoside triphosphate di | GDA1_CD39 | 5.1 |
| 419073 | AW372170 | Hs. 183918 | Homo sapiens cDNA FLJ12797 fis | ig, tsp_1, ZU5 | 5.1 |
| 409958 | NM_001523 | Hs.57697 | hyaluronan synthase 1 | Glycos_transf_2 | 5.1 |
| 442599 | AF078037 | Hs. 324051 | ReIA-associated inhibitor | SH3, ank | 5.1 |
| 424305 | BE386095 | Hs. 112272 | histone deacetylase 8 | Hist_deacetyl | 5.1 |
| 427247 | AW504221 | Hs.174103 | integrin, alpha L (antigen CD1 | vwa, integrin_A, FG-GAP | 5.1 |
| 429061 | Y14039 | Hs.195175 | CASP8 and FADD-like apoptosis | DED, ICE_p20 | 5.1 |
| 420849 | X52221 | Hs.99987 | excision repair cross-compleme | | 5.1 |
| 453337 | R73417 | Hs.25391 | gb yj92g12 r1 Soares breast 2N | GSPII_III | 5.1 |
| 418910 | Z25821 | Hs. 89466 | Homo sapiens, Similar to dodec | ECH | 5.1 |
| 425771 | BE561776 | Hs. 159494 | Bruton agammaglobulinemia tyro | SH2, SH3, pkinase, PH, BTK | 5.1 |
| 405202 | | | NM_021734* Homo sapiens deoxyn | mito_carr | 5.1 |
| 451452 | BE560065 | Hs.26433 | dolichyl-phosphate (UDP-N-acet | Glycos_transf_4 | 5.0 |
| 418231 | AA326895 | Hs. 83848 | triosephosphate isomerase 1 | TIM | 5.0 |
| 425165 | NM_014434 | Hs. 154899 | Target CAT | | 5.0 |
| 407876 | NM_004519 | Hs. 40866 | potassium voltage-gated channe | ion_trans, KCNQ1_channel | 5.0 |
| 417831 | H16423 | Hs.82685 | CD47 antigen (Rh-related antig | ig | 5.0 |
| 404716 | | | NM_007313*: Homo sapiens v-abl | SH2, SH3, pkinase | 5.0 |
| 405020 | | | Target Exon | 7tm_1 | 5.0 |

TABLE 16A-continued

| Pkey | ExAccn | UniGene ID | Unigene Title | Pred. Protein Dom. | R1 |
|---|---|---|---|---|---|
| 426236 | NM_004798 | Hs. 168212 | kinesin family member 3B | kinesin | 5.0 |
| 433178 | AB038269 | Hs.253706 | cysteinyl leukotriene CysLT2r | 7tm_1 | 5.0 |
| 422340 | AW296219 | Hs. 115325 | RAB7, member RAS oncogene fami | arf, ras | 5.0 |
| 439414 | NM_001183 | Hs. 6551 | ATPase, H transporting, lysoso | | 5.0 |
| 425846 | AA102174 | Hs. 159629 | myosin IXB | myosin_head, DAG_PE-bind, I | 5.0 |
| 413599 | AJ006239 | Hs. 75438 | quinoid dihydropteridine reduc | adh_short | 5.0 |
| 424168 | L29277 | Hs. 321677 | signal transducer and activato | SH2, STAT, STAT_bind, STAT_p | 5.0 |
| 436042 | AF284422 | Hs. 119178 | cation-chloride cotransporter- | aa_permeases | 5.0 |
| 410775 | AB014460 | Hs.66196 | nth (E coli endonuclease III)- | HhH-GPD | 5.0 |
| 428734 | BE303044 | Hs. 192023 | eukaryotic translation initiat | WD40 | 5.0 |
| 420340 | NM_000734 | Hs. 97087 | CD3Z antigen, zeta polypeptide | ITAM | 4.9 |
| 433075 | NM_002959 | | sortilin 1 | BNR | 4.9 |
| 400300 | X03363 | | HER2 receptor tyrosine kinase | pkinase | 4.9 |
| 426811 | BE259228 | Hs. 172609 | nucleobindin 1 | efhand | 4.9 |
| 401577 | | | NM_000761: Homo sapiens cytochr | p450 | 4.9 |
| 409637 | AA323948 | Hs. 55407 | Homo sapiens mRNA, cDNA DKFZp4 | Collagen | 4.9 |
| 426831 | BE296216 | Hs.172673 | S-adenosylhomocysteine hydrola | AdoHcyase | 4.9 |
| 430904 | U65402 | Hs. 248124 | G protein-coupled receptor 31 | 7tm_1 | 4.9 |
| 423552 | AF107028 | Hs. 129783 | sodium channel, voltage-gated, | ig, Adeno_E3_CR2 | 4.9 |
| 421487 | AF027406 | Hs. 104865 | serine/threonine kinase 23 | pkinase | 4.9 |
| 402183 | | | NM_004491* Homo sapiens glucoc | FF | 4.9 |
| 456748 | AW137749 | Hs.125902 | ubiquitin specific protease 2 | UCH-1, UCH-2 | 4.9 |
| 424771 | BE397151 | Hs.153003 | serine/threonine kinase 16 | pkinase | 4.9 |
| 406441 | | | Target Exon | Aa_trans | 4.9 |
| 437053 | AU077018 | Hs. 3235 | keratin 4 | filament, bZIP, Tropomyosin | 4.9 |
| 443044 | N28522 | Hs. 8935 | quinolinate phosphoribosyltran | QRPTase, QRPTase_N | 4.9 |
| 431204 | F28841 | Hs. 250760 | cytochrome c oxidase subunit V | dUTPase, COX6A, ras, ATP-syn | 4.9 |
| 456417 | L36531 | Hs.91296 | integrin, alpha 8 | integrin_A, FG-GAP | 4.8 |
| 436735 | L48489 | | mannosyl (beta-1,4-)-glycoprot | | 4.8 |
| 441455 | AJ271671 | Hs.7854 | zinc/iron regulated transporte | Zip | 4.8 |
| 446948 | BE409053 | Hs.299629 | peroxisomal long-chain acyl-co | | 4.8 |
| 451564 | AU076698 | Hs. 132760 | hypothetical protein MGC15729 | sugar_tr, Condensation | 4.8 |
| 403771 | | | NM_003061: Homo sapiens slit (D | EGF, laminin_G, LRR, LRRNT, L | 4.8 |
| 403248 | | | ESTs, Weakly similar to I78885 | SLT | 4.8 |
| 410214 | L29555 | Hs. 301698 | sialyltransferase 4A (beta-gal | Glyco_transf_29 | 4.8 |
| 407047 | X65965 | | gb H. sapiens SOD-2 gene for ma | sodfe | 4.8 |
| 422668 | AF199364 | Hs.119120 | E3 ubiquitin ligase SMURF1 | C2, WW, HECT | 4.8 |
| 436057 | AJ004832 | Hs. 5038 | neuropathy target esterase | cNMP_binding | 4.8 |
| 431262 | NM_006672 | Hs. 251395 | solute carrier family 22 (orga | sugar_tr | 4.8 |
| 406625 | Y13647 | Hs. 119597 | stearoyl-CoA desaturase (delta | FA_desaturase | 4.8 |
| 428659 | U66579 | Hs. 188859 | G protein-coupled receptor 20 | | 4.8 |
| 432716 | AI762964 | Hs. 205180 | ESTs | | 4.8 |
| 414460 | L00727 | Hs. 898 | dystrophia myotonica-protein k | pkinase | 4.8 |
| 400287 | S39329 | Hs. 181350 | kallikrein 2, prostatic | trypsin | 4.8 |
| 428946 | D42046 | Hs. 194665 | DNA2 (DNA replication helicase | UvrD-helicase, Viral_helic | 4.7 |
| 420028 | AB014680 | Hs.8786 | carbohydrate (N-acetylglucosam | Sulfotransfer | 4.7 |
| 402912 | | | Target Exon | pkinase | 4.7 |
| 443329 | BE262943 | Hs.9234 | hypothetical protein MGC1936 | | 4.7 |
| 426120 | AA325243 | Hs. 166887 | copine I | C2 | 4.7 |
| 430609 | AA302921 | Hs. 247362 | dimethylarginine dimethylamino | | 4.7 |
| 451320 | AW118072 | | diacylglycerol kinase, zeta (1 | zf-C2H2, BAR, SH3 | 4.7 |
| 447131 | NM_004585 | Hs. 17466 | retinoic acid receptor respond | | 4.7 |
| 431222 | X56777 | Hs. 273790 | zona pellucida glycoprotein 3A | zona_pellucida | 4.7 |
| 406458 | | | C14000133* gi|1082739|pir||C44 | proteasome | 4.7 |
| 427804 | AL049654 | Hs. 180871 | protein kinase C, alpha bindin | PDZ | 4.7 |
| 450748 | AI733093 | Hs.247686 | ESTs | 7tm_1 | 4.7 |
| 422937 | U03270 | Hs. 122511 | centrin, EF-hand protein, 1 | efhand | 4.7 |
| 407978 | AW385129 | Hs. 41717 | phosphodiesterase 1A, calmodul | PDEase | 4.7 |
| 428773 | BE6256238 | Hs. 193163 | bridging integrator 1 | SH3, BAR | 4.7 |
| 456444 | AA884517 | Hs.31856 | ESTs, Weakly simitar to KIAA14 | | 4.7 |
| 405574 | | | Target Exon | pkinase | 4.7 |
| 442414 | BE408758 | Hs. 8297 | ribonuclease 6 precursor | ribonuclease_T2 | 4.7 |
| 418289 | AW403103 | Hs. 83951 | Hermansky-Pudlak syndrome | | 4.6 |
| 421601 | AI660190 | Hs. 106070 | cyclin-dependent kinase inhibt | CDI | 4.6 |
| 422795 | AB033109 | Hs. 120866 | KIAA1283 protein | kazal, A2M, A2M_N | 4.6 |
| 433019 | AI208513 | Hs. 279915 | transfocase of inner mitochond | zf-Tim10_DDP | 4.6 |
| 431522 | AI625859 | Hs.258609 | protein tyrosine phosphatase, | fn3, Y_phosphatase | 4.6 |
| 400846 | | | sortilin-related receptor, L(D | Idl_recept_a, fn3, Idl_rece | 4.6 |
| 456881 | AW028302 | Hs. 155079 | protein phosphatase 2, regulat | B56 | 4.6 |
| 418172 | X61157 | Hs. 83636 | adrenergic, beta, receptor kin | pkinase, PH, RGS | 4.6 |
| 408433 | AW162931 | Hs. 45002 | ras-related C3 botulinum toxin | ras | 4.6 |
| 439671 | AL110209 | Hs.6770 | LCAT-like lysophospholipase | LACT | 4.6 |
| 427122 | AW057736 | Hs. 323910 | HER2 receptor tyrosine kinase | pkinase, Furin-like, Recep_ | 4.6 |
| 427945 | AW137156 | Hs. 181202 | hypothetical protein FLJ10038 | Collagen | 4.6 |
| 451777 | U09210 | Hs. 459 | solute carrier family 18 (vesi | sugar_tr | 4.6 |
| 429938 | BE296804 | Hs.226377 | phosphate cytidylyltransferase | Cytidylyltransf, COX6C | 4.6 |
| 412974 | R18978 | Hs. 75105 | emopamil-binding protein (ster | | 4.6 |

TABLE 16A-continued

| Pkey | ExAccn | UniGene ID | Unigene Title | Pred. Protein Dom. | R1 |
|---|---|---|---|---|---|
| 414702 | L22005 | Hs. 76932 | cell division cycle 34 | UQ_con | 4.6 |
| 425795 | AJ000479 | Hs. 159543 | endothelial differentiation, G | 7tm__1 | 4.6 |
| 422454 | U49070 | Hs.161362 | protein (peptidyl-prolyl cis/t | Rotamase, WW | 4.6 |
| 408135 | AA317248 | Hs.42957 | methyltransferase-like 1 | Methyltransf_4 | 4.6 |
| 457388 | AF035300 | Hs. 264157 | cadherin-like 22 | cadherin, Cadherin__C__term | 4.6 |
| 421140 | AA298741 | Hs. 102135 | signal sequence receptor, delt | Herpes__UL3 | 4.6 |
| 434834 | AF156774 | Hs. 324020 | 1-acylglycerol-3-phosphate O-a | Acyltransferase | 4.6 |
| 413407 | AI356293 | Hs.75339 | inositol polyphosphate phospha | SH2, SAM | 4.6 |
| 402463 | | | NM__014624 Homo sapiens S100 ca | efhand, S__100 | 4.5 |
| 417891 | W79410 | Hs. 82887 | protein phosphatase 1, regulat | | 4.5 |
| 421681 | AA384922 | Hs. 195175 | CASP8 and FADD-like apoptosis | ICE_p20, DED | 4.5 |
| 426516 | BE262660 | Hs.170197 | glutamic-oxaloacetic transamin | aminotran_1_2 | 4.5 |
| 418963 | BE304571 | Hs. 89529 | aldo-keto reductase family 1, | aldo__ket__red | 4.5 |
| 423664 | NM__004714 | Hs. 130988 | dual-specificity tyrosine-(Y)- | pkinase | 4.5 |
| 427681 | AB018263 | Hs. 180338 | tumor necrosis factor receptor | TNFR_c6, death, PH, Xlink, Rh | 4.5 |
| 432893 | NM__016154 | Hs.279771 | Homo sapiens clone PP1596 unkn | ras, arf | 4.5 |
| 413815 | AL046341 | Hs. 75562 | dincoidin domain receptor fami | F5__F8__type__C, pkinase | 4.5 |
| 405546 | | | NM__018833* Homo sapiens transp | ABC__membrane, ABC__tran | 4.5 |
| 416297 | AA157634 | Hs. 79172 | solute carrier family 25 (mito | mito__carr | 4.5 |
| 421962 | D82061 | Hs. 288354 | FabG (beta-ketoacyl-[acyl-carr | adh__short | 4.5 |
| 415341 | R00602 | | gb: ye74c04 r1 Soares fetal liv | pkinase | 4.5 |
| 456668 | W81526 | Hs. 118329 | ESTs, Moderately similar to GA | Neur__chan__LBD, Neur__chan__m | 4.5 |
| 456652 | AW327546 | Hs.111024 | solute carrier family 25 (mito | mito__carr | 4.5 |
| 407863 | AA317089 | Hs. 597 | glutamic-oxaloacetic transamin | aminotran_1_2 | 4.5 |
| 435891 | AW249394 | Hs. 5002 | copper chaperone for superoxid | sodcu, HMA | 4.5 |
| 453997 | AW247615 | Hs. 37003 | v-Ha-ras Harvey rat sarcoma vi | ras | 4.5 |
| 449029 | N28989 | Hs. 22891 | solute carrier family 7 (catio | aa__permeases | 4.5 |
| 424829 | NM__002507 | Hs. 1827 | nerve growth factor receptor ( | death, TNFR__c6 | 4.5 |
| 429362 | T25833 | Hs. 200478 | ubiquitin-conjugating enzyme E | UQ__con | 4.5 |
| 429133 | N31854 | Hs. 197116 | solute carrier family 7 (catio | aa__permeases | 4.5 |
| 426079 | D31220 | Hs.166168 | peter pan (Drosophila) homolog | 7tm__1 | 4.4 |
| 414814 | D14697 | Hs.77393 | farnesyl diphosphate synthase | pelyprenyl__synt | 4.4 |
| 433261 | AB040967 | Hs. 112034 | KIAA1534 protein | PH, Oxysterol__BP | 4.4 |
| 402915 | | | ENSP00000202587* Bicarbonate t | HCO3__cotransp | 4.4 |
| 418267 | BE389537 | Hs. 83919 | glucosidase I | Glyco__hydro__63 | 4.4 |
| 430716 | BE387257 | Hs. 247831 | Homo sapiens, Similar to myosi | efhand | 4.4 |
| 420874 | X66357 | Hs. 336478 | cyclin-dependent kinase 3 | pkinase | 4.4 |
| 439902 | AF174499 | Hs.6764 | histone deacetylane 6 | Hist__deacetyl, zf-UBP | 4.4 |
| 400223 | | | Eos control | Skp1 | 4.4 |
| 450611 | NM__004405 | Hs. 419 | distal-less homeo box 2 | homeobox | 4.4 |
| 412965 | L06419 | Hs. 75093 | procollagen-lysine, 2-oxogluta | 2OG-FeII__Oxy | 4.4 |
| 435564 | AF210652 | Hs.16614 | 5(3)-deoxyribonucleotidase (dN | | 4.4 |
| 416121 | X92762 | Hs. 79021 | tafazzin (cardiomyopathy, dila | Acyltranferase | 4.4 |
| 423323 | AI951628 | Hs. 127007 | potassium channel, subfamily K | ion__trans | 4.4 |
| 448191 | NM__005881 | Hs.20644 | branched chain alpha-ketoacid | HATPase__c | 4.4 |
| 456217 | BE253181 | Hs. 81687 | non-metastatic cells 3, protei | NDK, Arten__glycop | 4.4 |
| 436415 | BE265254 | Hs. 343258 | proliferation-associated 2G4, | Peptidase__M24 | 4.4 |
| 429218 | AA225065 | Hs. 198269 | Target CAT | | 4.4 |
| 407433 | AF209923 | | gb: Homo sapiens orphan G-prote | 7tm__3 | 4.4 |
| 425955 | T96509 | Hs.248549 | ESTs, Moderately similar to S6 | | 4.4 |
| 407230 | AA157857 | Hs.182265 | keratin 19 | filament, bZIP | 4.3 |
| 410197 | NM__005518 | Hs.59889 | 3-hydroxy-3-methylglutaryl-Coe | HMG__CoA__synt | 4.3 |
| 416409 | R61573 | Hs. 79300 | ubiquitin-conjugating enzyme E | UQ__con | 4.3 |
| 447957 | NM__014821 | Hs. 20126 | KIAA0317 gene product | Filamin, HECT | 4.3 |
| 421771 | NM__001224 | Hs.108131 | caspase 2, apoptosis-related c | ICE_p20, CARD, ICE_p10 | 4.3 |
| 448886 | AL137291 | Hs. 22451 | hypothetical protein FLJ10357 | PH, RhoGEF | 4.3 |
| 414821 | M63835 | Hs. 77424 | Fc fragment of IgG, high affin | ig | 4.3 |
| 431096 | AA324358 | Hs. 249227 | Homo sapiens DNA, cosmid clone | | 4.3 |
| 429892 | NM__003803 | Hs.2504 | myomesin 1 (skelemin) (185 kD) | ig, fn3 | 4.3 |
| 450126 | BE018138 | Hs.24447 | sigma receptor (SR31747 bindin | | 4.3 |
| 413781 | J05272 | Hs.850 | IMP (inosine monophosphate) de | IMPDH__C, IMPDH__N, CBS, NPD | 4.3 |
| 406530 | | | NM__005546* Homo sapiens IL2-in | SH2, SH3, pkinase, PH, BTK | 4.3 |
| 428363 | AK000284 | Hs. 183860 | hypothetical protein FLJ20277 | GNT-I | 4.3 |
| 413954 | AL037111 | Hs. 75641 | galactose-1-phosphate uridylyl | GalP__UDP__transf, GalP__UDP__ | 4.3 |
| 432179 | X75208 | Hs.2913 | EphB3 | EPH__lbd, fn3, pkinase, SAM | 4.3 |
| 456529 | AF014643 | Hs. 100072 | connexin46.6 | connexin | 4.3 |
| 448988 | Y09763 | Hs. 22785 | gamma-aminobutyric acid (GABA) | Neur__chan__LBD, Neur__chan__m | 4.3 |
| 426626 | AI124572 | Hs.323679 | inhibitor of kappa light polyp | zf-C2H2 | 4.3 |
| 432956 | AL037895 | Hs. 279861 | CGI-31 protein | thiored | 4.3 |
| 428970 | BE276891 | Hs. 194691 | retinoic acid induced 3 | 7tm__3 | 4.3 |
| 428953 | AA306610 | Hs.348183 | tumor necrosis factor receptor | TNFR__c6 | 4.2 |
| 423922 | AK001663 | Hs. 135458 | muscle-specific beta 1 integri | | 4.2 |
| 426613 | U96132 | Hs. 171280 | hydroxyacyl-Coenzyme A dehydro | adh__short | 4.2 |
| 426566 | AF131836 | Hs. 170453 | tropomodulin | Tropomodulin, pkinase | 4.2 |
| 425179 | AJ224442 | Hs.155020 | putative methyltransferase | | 4.2 |
| 412715 | NM__000947 | Hs. 74519 | primase, polypeptide 2A (58 kD) | | 4.2 |
| 459298 | R86701 | | gb: ym86d09.r1 Soares adult bra | | 4.2 |

TABLE 16A-continued

| Pkey | ExAccn | UniGene ID | Unigene Title | Pred. Protein Dom. | R1 |
|---|---|---|---|---|---|
| 404879 | | | NM_030807 Homo sapiens glucose | | 4.2 |
| 400836 | | | Target Exon | Apolipoprotein | 4.2 |
| 430940 | Z25470 | Hs. 248145 | melanocortin 5 receptor | | 4.2 |
| 400563 | | | Target Exon | Pep_M12B_propep | 4.2 |
| 430237 | AI272144 | Hs. 236522 | DKFZP434P106 protein | abhydrolase | 4.2 |
| 425175 | AF020202 | Hs.155001 | UNC13 (C. elegans)-like | DAG_PE-bind, C2 | 4.2 |
| 409067 | BE260459 | Hs. 50267 | putative GTP-binding proteins | ras | 4.2 |
| 419982 | AA252544 | Hs. 55610 | solute carrier family 30 (zinc | | 4.2 |
| 428394 | AU076472 | Hs.184141 | glutaryl-Coenzyme A dehydrogen | Acyl-CoA_dh, Acyl-CoA_dh_M | 4.2 |
| 437696 | Z83844 | Hs. 5790 | hypothetical protein dJ37E16 5 | Hydrolase | 4.2 |
| 454034 | NM_000691 | Hs. 575 | aldehyde dehydrogenase 3 famil | aldedh | 4.2 |
| 410237 | AI750589 | Hs. 61258 | argininosuccinate lyase | lyase_1 | 4.1 |
| 451478 | NM_012331 | Hs.26458 | methionine sulfoxide reductase | PMSR | 4.1 |
| 415410 | AF037332 | Hs.278569 | sorting nexin 17 | PX, fn3, pkinase, SAM, EPH_lb | 4.1 |
| 406538 | | | Target Exon | trypsin | 4.1 |
| 424349 | AF141289 | Hs. 145550 | solute carrier family 7 (catio | aa_permeases | 4.1 |
| 441164 | AB023180 | Hs. 7724 | KIAA0963 protein | helicase_C | 4.1 |
| 421318 | U63973 | Hs. 103501 | rhodopsin kinase | pkinase, pkinase_C, RGS | 4.1 |
| 439340 | AB032436 | Hs. 6535 | brain-specific Na-dependent in | sugar_tr, BT1 | 4.1 |
| 417447 | N73703 | Hs.293267 | ESTs | Glyco_hydro_31 | 4.1 |
| 409693 | AA010233 | Hs. 55921 | glutamyl-prolyl-tRNA synthetas | WHEP-TRS, GST_C, HGTP_antic | 4.1 |
| 403655 | | | NM_003071. Homo sapiens SWI/SNF | SNF2_N, helicase_C, zt-C3HC | 4.1 |
| 411142 | NM_014256 | Hs.69009 | transmembrane protein 3 | Galactosy_T | 4.1 |
| 437016 | AU076916 | Hs. 5398 | guanine monphosphate synthetas | GMP_synt_C, GATase | 4.1 |
| 422699 | BE410590 | Hs. 119257 | ems1 sequence (mammary tumor a | SH3, HS1_rep | 4.1 |
| 427202 | BE272922 | Hs.173936 | interleukin 10 receptor, beta | Tissue_fac | 4.1 |
| 421380 | D31833 | Hs. 1372 | arginine vasopressin receptor | 7tm_1 | 4.1 |
| 434142 | U47927 | Hs. 3759 | ubiquitin specific protease 5 | zf-UBP, UCH-2, UBA, UCH-1 | 4.1 |
| 427407 | BE268649 | Hs. 177766 | ADP-ribosyltransferase (NAD, p | BRCT, PARP, zf-PARP, PARP_re | 4.1 |
| 413749 | AI929320 | Hs. 75516 | tyrosine kinase 2 | pkinase | 4.1 |
| 411927 | BE274009 | Hs.772 | glycogen synthase 1 (muscle) | Glycos_transf_1 | 4.1 |
| 419726 | U50330 | Hs.1274 | bone morphogenetic protein 1 | EGF, CUB, Astacin | 4.1 |
| 423814 | AF105020 | Hs. 132989 | putative protein O-mannosyltra | PMT, MIR | 4.1 |
| 451355 | NM_004197 | Hs. 444 | serine/threonine kinase 19 | | 4.1 |
| 422556 | NM_006245 | Hs. 118244 | protein phosphatase 2, regulat | B56 | 4.1 |
| 428284 | AA535762 | Hs. 183435 | NM_004545 Homo sapiens NADH de | | 4.1 |
| 431968 | AF117222 | Hs. 272261 | UDP-Gal betaGlcNAc beta 1,3-ga | Galactosyl_T | 4.0 |
| 443639 | BE269042 | Hs. 9661 | proteasome (prosome, macropain | proteasome | 4.0 |
| 410039 | AF207989 | Hs. 58014 | Homo sapiens, Similar to G pro | 7tm_3 | 4.0 |
| 431066 | AF026273 | Hs. 249175 | interleukin-1 receptor-associa | pkinaae, death | 4.0 |
| 452715 | Z21093 | Hs. 30352 | ribosomal protein S6 kinase, 5 | pkinaae | 4.0 |
| 403692 | | | NM_007037* Hams sapiens a disi | Reprotysin, tsp_1, Pep_M12B | 4.0 |
| 442549 | AI751601 | Hs. 8375 | TNF receptor-associated factor | zf-C3HC4, MATH, zf-TRAF | 4.0 |
| 427239 | BE270447 | | ubiquitin carrier protein | UQ_con | 4.0 |
| 451125 | AA015779 | Hs. 226923 | ESTs | Y_phosphatase | 4.0 |
| 425081 | X74794 | Hs. 154443 | minichromosome maintenance def | MCM | 4.0 |
| 402171 | | | Target Exon | C2 | 4.0 |
| 402665 | | | Target Exon | | 4.0 |
| 420148 | U34227 | Hs.95361 | myosin VIIA (Usher syndrome 1 B | myosin_head, IQ, MyTH4, SH3, | 4.0 |
| 412187 | U68487 | Hs. 73739 | 5-hydroxytryptamine (serotonin | 7tm_1 | 4.0 |
| 412656 | AF006011 | Hs. 74375 | dishevelled 1 (homologous to D | PDZ, DEP, DIX, Dishevelled | 4.0 |
| 425786 | U35234 | Hs. 159534 | protein tyrosine phosphatase, | fn3, ig, Y_phosphatase, DSPc | 4.0 |
| 424288 | AW137198 | Hs. 278682 | Phosphatidylglycerophosphate S | | 4.0 |
| 452230 | AW135360 | Hs. 224170 | ESTs | pkinase | 4.0 |
| 408449 | NM_004408 | Hs.166161 | dynamin 1 | PH, GED, dynamin, dynamin_2 | 4.0 |
| 423883 | AF250238 | Hs.134514 | ATP-binding cassette, sub-fami | ABC_tran, photoRC, SRP54, Ca | 4.0 |
| 422676 | D28481 | Hs. 1570 | histamine receptor H1 | 7tm_1 | 4.0 |
| 458639 | BE247683 | Hs. 14611 | dual specificity phosphatase 1 | DSPc | 4.0 |
| 400726 | | | C13000717* gi|129376|sp|P26196 | DEAD, helicase_C | 4.0 |
| 405370 | | | NM_005569* Homo sapiens LIM do | pkinase, LIM, PDZ | 4.0 |
| 413654 | AA331881 | Hs.75454 | peroxiredoxin 3 | AhpC-TSA | 4.0 |
| 432917 | NM_014125 | Hs. 241517 | PRO0327 protein | | 4.0 |
| 448362 | AA641767 | Hs. 21015 | hypothetical protein DKFZp564L | sugar_tr | 4.0 |
| 424512 | X53002 | Hs. 149846 | integrin, beta 5 | integrin_B, EGF | 4.0 |

Pkey: Unique Eos probeset identifier number
ExAccn: Exemplar Accession number, Genbank accession number
UnigeneID: Unigene number
Unigene Title: Unigene gene title
Pred. Protein Dom.: Predicted protein domain
R1: Ratio of tumor to normal body tissue

TABLE 16B

| Pkey | CAT Number | Accession |
|---|---|---|
| 410191 | 11824_1 | AI609645 AI818201 AA948024 AI278970 AA688086 AA858279 F21973 W95840 AW969644 X99726 AA431579 AA970887 AI885085 AI767835 BE566516 AA725824 AI000871 AW242322 AW007204 W68289 AA431450 AW466973 BE222544 AA483454 AI968050 W95975 AI381017 AA776726 AI040976 AA89 |
| 415341 | 1534442_1 | R00602 Z42921 F06132 |
| 415995 | 1564_1 | NM_004573 M95678 BE242666 AW504110 AW408049 AW402206 AA774879 AW630959 AI439623 AI933994 AW751282 AW374413 AA578823 H18054 AA310466 F12578 T74300 AA353176 AW950138 AW950600 AA912021 AI524064 AW183098 AI416986 AW769231 AI767111 AA293723 AI422290 AA465038 A |
| 418964 | 1809680_1 | T74640 T74649 |
| 424339 | 23827_1 | BE257148 BE312111 AF219137 NM_015720 BE313658 BE382652 BE252205 BE251553 F12128 T66208 BE255806 BE254484 AA324163 H07952 AL134164 AI867802 AI204971 AI282924 AW192547 AI652760 AI266471 AI083778 |
| 427010 | 27436_1 | AW138332 AW207450 AW138931 AW136963 NM_012219 AF043938 AA931386 AI084600 AA975999 BE551105 AA450260 AI080368 AA324154 AF022080 BE009901 AL118847 W44458 AI765270 AA453121 AI148638 AI373696 AA324153 BE174809 AA350765 |
| 427239 | 27647_1 | BE270447 AW409921 BE207288 BE207170 D56355 BE263223 BE408171 BE262243 BE392439 BE292738 BE261776 BE314300 BE267719 BE268715 BE513876 BE295291 BE297066 AA210923 BE407519 H51344 BE622905 AW248281 AW250313 T19021 AA355115 AA316879 BE269633 BE621936 AA290724 |
| 427326 | 277229_1 | AI287878 AI804160 AA400787 |
| 428542 | 29266_1 | D79989 NM_014770 U81031 AA352392 AA984512 H38328 AL120358 AL134787 AL134589 AI637763 AI671506 AA526909 AI651627 AW243560 AA939069 |
| 428948 | 29737_1 | BE514362 AI879343 BE272870 BE616390 AW163444 AW161588 AW378754 AW238803 BE267205 BE047746 BE207213 BE312782 BE266301 BE266413 BE278348 BE280885 BE278833 BE281417 BE407786 BE378176 BE392818 AW377597 BE395951 BE393978 AW327483 BE394175 BE385795 BE275663 BE3 |
| 432118 | 341702_-1 | N98718 |
| 432499 | 34857_1 | BE276633 NM_016577 AF166492 BE276152 AF091031 AA908607 U66623 AI570393 AA682567 AW593957 AI148105 AW002431 AI637463 AI767195 AA339439 R13005 R23431 AW961068 AA233819 AA224118 R19618 AI890314 Z46184 |
| 433075 | 35820_1 | NM_002959 X98248 AA233278 AA846376 AI470560 AI470533 BE327147 AW291971 AA017125 AI198417 AI365213 AI168442 AI337018 AI475049 H85459 AA969895 AA888000 AA418326 AA418378 N71981 AL043634 AA426361 AA418275 AA232975 AL036861 BE277220 BE387505 N99710 AW375004 A |
| 433494 | 3679_1 | AB029396 T04934 R21715 R19005 H11563 H14256 R46605 Z40857 BE218899 AI457785 BE550988 AI693847 AA961017 H40944 M78617 H38447 N80090 BE549719 BE550952 AW005546 AI332686 AI928848 N49234 R44075 AI694943 AI858538 AI290722 BE550759 R43116 H40212 H40089 AA018091 |
| 434755 | 392764_1 | AA648502 AA814365 AW976711 AA746117 |
| 436735 | 425_1 | L48489 AL022312 D13789 AI761974 AW173260 AW271715 AA837437 AI075278 AI367012 AI953032 AI571173 H44868 AA743691 H47026 AA837368 AA829826 AA713585 AW502618 AW500856 AW501353 AW499765 AA339125 H19141 H29645 R18883 AW450375 AA326081 AW406015 BE263659 N52684 A |
| 440242 | 489536_1 | AW295871 AI005144 AA909877 T52634 AI239684 AA875959 BE171353 AI767633 AW510907 AI742007 |
| 449405 | 80651_1 | AA001350 AA203114 H83070 R00660 |
| 450739 | 844917_1 | AI732707 AI742120 |
| 451320 | 86576_1 | AW118072 AI631982 T15734 AA224195 AI701458 W20198 F26326 AA890570 N90552 AW071907 AI671352 AI375892 T03517 R88265 AI124088 AA224388 AI084316 AI354686 T33652 AI140719 AI720211 T03490 AI372637 T15415 AW205836 AA630384 T03515 T33230 AA017131 AA443303 T33623 |
| 459298 | 983107_1 | R86701 R84600 AL157655 |

Pkey: Unique Eos probeset identifier number
CAT number Gene cluster number
Accession Genbank accession numbers

TABLE 16C

| Pkey | Ref | Strand | Nt_position |
|---|---|---|---|
| 400471 | 9931670 | Minus | 105629–105760 |
| 400518 | 9796703 | Plus | 37240–37774 |
| 400551 | 9801071 | Minus | 40629–40934 |

TABLE 16C-continued

| Pkey | Ref | Strand | Nt_position |
|---|---|---|---|
| 400563 | 9844011 | Plus | 81941–82434 |
| 400565 | 9863505 | Minus | 93178–93429 |
| 400726 | 8118950 | Plus | 51524–51786 |
| 400748 | 8119063 | Plus | 84237–84398 |
| 400772 | 8131629 | Minus | 34896–35021, 41078–41197 |
| 400833 | 8705148 | Minus | 187599–188138 |
| 400836 | 8954179 | Plus | 677–1188 |
| 400843 | 9188605 | Plus | 5863–5970, 7653–7784, 8892–9023, 9673–9807, 10634–10789, 15254–15403, 23827–23958 |
| 400845 | 9188605 | Plus | 34428–34612 |
| 400846 | 9188605 | Plus | 39310–39474 |
| 400894 | 9958307 | Minus | 84607–85554 |
| 400933 | 7651935 | Minus | 105330–105503 |
| 400985 | 8085497 | Minus | 5856–6006, 6236–6402 |
| 401118 | 9966714 | Minus | 111939–112126 |
| 401134 | 7210005 | Plus | 51210–51406 |
| 401180 | 9438648 | Minus | 150981–152128 |
| 401215 | 9858408 | Plus | 103739–103919 |
| 401281 | 9800073 | Minus | 13622–15130 |
| 401454 | 9186923 | Minus | 114659–114832 |
| 401488 | 7341775 | Plus | 54523–54686, 55364–55451, 55737–55846, 58047–58175, 58261–58356 |
| 401507 | 7534110 | Plus | 71055–71259 |
| 401510 | 7622346 | Minus | 46835–47126 |
| 401542 | 8072607 | Minus | 87695–87840 |
| 401577 | 9280797 | Minus | 139377–139674, 141195–141281, 142217–142340 |
| 401736 | 3219338 | Plus | 1771–1894 |
| 401885 | 8140731 | Plus | 148234–148321, 150365–150559 |
| 401935 | 3808091 | Plus | 46329–46473 |
| 401960 | 3249127 | Minus | 87589–88081 |
| 402053 | 8083229 | Plus | 62703–63179 |
| 402115 | 8547592 | Minus | 101750–102018 |
| 402171 | 8575908 | Minus | 79357–79514, 83258–83476 |
| 402183 | 7658390 | Minus | 100618–104298 |
| 402191 | 8576073 | Minus | 69410–69583 |
| 402207 | 8576119 | Plus | 41683–41851 |
| 402209 | 8576119 | Minus | 53315–53472 |
| 402211 | 7689783 | Minus | 67414–68229 |
| 402338 | 6957691 | Minus | 36915–37250 |
| 402393 | 9929688 | Plus | 19813–20084, 20163–20263 |
| 402453 | 7534025 | Plus | 41–631 |
| 402460 | 9796884 | Minus | 108901–109254, 110246–110581, 113613–113960 |
| 402463 | 9796896 | Minus | 8818–8952 |
| 402478 | 9797301 | Minus | 106204–106535 |
| 402497 | 9797775 | Plus | 98984–99452 |
| 402632 | 9931268 | Plus | 101166–101419 |
| 402651 | 7960391 | Plus | 174215–174380 |
| 402665 | 8077033 | Minus | 11824–12090, 14290–14544 |
| 402758 | 9213869 | Plus | 87638–87924 |
| 402760 | 9213869 | Plus | 136829–136952, 137336–137521 |
| 402823 | 8217451 | Plus | 57916–58170, 58475–58759, 59580–59867 |
| 402912 | 7263904 | Plus | 145965–146257, 150876–151368 |
| 402915 | 7406502 | Minus | 140–276 |
| 402916 | 7406502 | Minus | 361–474, 541–687 |
| 403213 | 7630897 | Minus | 162572–162739, 164442–164540 |
| 403248 | 7656833 | Minus | 167439–167606 |
| 403268 | 7230852 | Minus | 73832–73962 |
| 403379 | 9438244 | Minus | 117348–117560 |
| 403655 | 8736093 | Plus | 65668–65859 |
| 403672 | 7283286 | Minus | 96600–96881, 96951–97280, 97393–97594 |
| 403692 | 7387384 | Minus | 93803–93938 |
| 403771 | 7770492 | Plus | 112901–113045 |
| 403949 | 7711972 | Minus | 1731–1941 |
| 404199 | 6010176 | Minus | 1669–2740 |
| 404527 | 8152087 | Plus | 127737–127796, 128080–128210, 129888–130054, 132545–132869 |
| 404528 | 8152087 | Plus | 135325–135486 |
| 404596 | 9958262 | Minus | 104807–105043 |
| 404676 | 9797204 | Minus | 56167–56342, 58066–58189, 58891–59048, 60452–60628 |
| 404679 | 9797204 | Plus | 125964–126092, 126691–127011, 127774–127893 |
| 404716 | 9838068 | Minus | 123145–123417 |
| 404757 | 7706327 | Plus | 100933–101083, 101580–101782 |
| 404879 | 5103013 | Plus | 78346–78473, 78693–78893 |
| 404946 | 7382189 | Plus | 134445–134750 |
| 404953 | 7387324 | Plus | 16588–17031 |
| 404968 | 6899755 | Plus | 39287–39606 |
| 405020 | 7137674 | Plus | 106606–107309 |
| 405137 | 8570507 | Plus | 158969–159423 |
| 405187 | 7229826 | Plus | 117025–117170, 118567–118736 |
| 405202 | 7230116 | Plus | 40209–40429 |

TABLE 16C-continued

| Pkey | Ref | Strand | Nt_position |
|---|---|---|---|
| 405282 | 3810573 | Minus | 10482–10689 |
| 405370 | 2078469 | Minus | 38980–39111 |
| 405371 | 2078469 | Minus | 47657–47766, 48461–48596 |
| 405473 | 8439781 | Plus | 153074–153343, 154501–154598, 156879–156999, 158863–159051, 159910–160053, 161109–161229, 163035–163131, 165163–165259, 165868–166003, 167375–167552, 169252–169364, 171127–171281 |
| 405474 | 8439781 | Plus | 172005–172175 |
| 405546 | 1054740 | Plus | 124010–124183 |
| 405574 | 3820491 | Minus | 33200–33646 |
| 405594 | 6960456 | Plus | 161628–161734, 162823–163014, 164439–164652 |
| 405683 | 4508157 | Minus | 21701–21844 |
| 405697 | 4309923 | Minus | 56765–57010, 57696–58016 |
| 405714 | 4156179 | Minus | 42789–43553 |
| 406128 | 9159110 | Plus | 50425–50876 |
| 406370 | 9256130 | Plus | 125320–125482 |
| 406432 | 9256504 | Plus | 3804–3930, 4026–4120, 4929–5109 |
| 406441 | 9280715 | Plus | 26200–26458 |
| 406458 | 9756020 | Plus | 145874–146911 |
| 406495 | 7711328 | Minus | 174661–174978 |
| 406496 | 7711328 | Minus | 178947–179264, 181779–182087 |
| 406530 | 7711474 | Minus | 11703–11860, 14711–14829, 14920–14984, 16232–16448, 16916–17087 |
| 406538 | 7711478 | Plus | 35196–35367, 38229–38476, 40080–40216, 43522–43840 |
| 406591 | 8224230 | Minus | 2117–2257, 2436–2540 |
| 406617 | 8439858 | Plus | 36430–36552 |

Pkey: Unique number corresponding to an Eos probeset
Ref: Sequence source The 7 digit numbers in this column are Genbank Identifier (GI) numbers "Dunham I et al." refers to the publication entitled "The DNA sequence of human chromosome 22" Dunham, et al (1999) Nature 402: 489–495
Strand Indicates DNA strand from which exons were predicted
Nt_position Indicates nucleotide positions of predicted exons Table 17A lists about 779 genes up-regulated in ovarian cancer compared to non-malignant adult ovaries These were selected as for Table 14A, except that the ratio of "average" ovarian cancer to "average" normal ovaries was greater than or equal to 4.0, the "average" ovarian cancer level was set to the 93rd percentile value amongst various ovarian cancer specimens, the "average" normal adult tissue level was set to the 93rd percentile value amongst various non-malignant adult ovaries, the "average" ovarian cancer value was greater than or equal to 200 units

TABLE 17A

| Pkey | ExAccn | UniGene ID | Unigene Title | Pred Protein Dom. | R1 |
|---|---|---|---|---|---|
| 421296 | NM_002666 | Hs. 103253 | perilipin | perilipin, SS | 37.8 |
| 437897 | AA770561 | Hs.146170 | hypothetical protein FLJ22969 | SS, TM, zf-DHHC | 29.2 |
| 453028 | AB006532 | Hs. 31442 | RecQ protein-like 4 | DEAD, helicase_C, Fork_head | 27.6 |
| 441021 | AW578716 | Hs.7644 | H1 histone family, member 2 | | 27.2 |
| 422310 | AA316622 | Hs.98370 | cytochrome P450, subfamily IIS | SS, TM, pkinase, fn3, ig | 26.5 |
| 454017 | AW023617 | Hs. 347130 | hypothetical protein FLJ22709 | SS, TM, myosin_head, RA, DAG_ | 25.9 |
| 438424 | AI912498 | Hs. 25895 | hypothetical protein FLJ14996 | SS, TM | 25.8 |
| 435017 | AA336522 | Hs. 12854 | angiotensin II, type I recepto | | 25.0 |
| 409518 | BE384836 | Hs. 3454 | KIAA1821 protein | SS | 23.3 |
| 410418 | D31382 | Hs. 63325 | transmembrane protease, serine | SS, TM, ldl_recept_a, trypsi | 22.8 |
| 439924 | AI985897 | Hs.125293 | ESTs | SS | 22.7 |
| 446374 | AA329256 | Hs.24756 | ESTs, Moderately similar to al | | 22.6 |
| 431773 | BE409442 | Hs. 268557 | pleckstrin homology-like domai | PH, SS, LIM, Troponin | 21.4 |
| 420839 | AI792682 | Hs.282960 | hypothetical protein MGC10870 | SS, DS, UPF0139, Glyco_hydro | 21.4 |
| 413436 | AF238083 | Hs. 68061 | sphingosine kinase 1 | DAGKc | 21.2 |
| 424420 | BE614743 | Hs. 146688 | prostaglandin E synthase | MAPEG, SS, TM, MAPEG | 20.7 |
| 422645 | L40027 | Hs. 118890 | glycogen synthase kinase 3 alp | pkinase, SS, Ets | 20.7 |
| 436725 | BE045223 | Hs.136912 | hypothetical protein MGC10796 | | 20.4 |
| 422098 | H03117 | Hs.111497 | similar to mouse neuronal prot | TM | 20.2 |
| 429556 | AW139399 | Hs. 98988 | ESTs | SS, pkinase, PMP22_Claudin | 20.1 |
| 434068 | AA977935 | Hs. 127274 | ESTs | SS | 20.0 |
| 423767 | H18283 | Hs. 132753 | F-box only protein 2 | F-box, SS, F-box, HORMA | 19.9 |
| 423652 | AF052122 | Hs. 130712 | *Homo sapiens* clone 23929 mRNA | ABC1, SS, PID, PID | 19.8 |
| 422179 | AF091619 | Hs. 112667 | dynein, axonemal, intermediate | WD40, SS | 19.3 |
| 441356 | BE384361 | Hs.182885 | ESTs, Weakly similar to JC5024 | SS, TM, ank | 18.5 |
| 418969 | W33191 | Hs.28907 | hypothetical protein FLJ20258 | SH3, SH3 | 17.2 |
| 432631 | H08379 | Hs. 165563 | hypothetical protein DKFZp434N | TM, DnaJ, UBA, ArfGap, homeob | 17.2 |
| 439108 | AW163034 | Hs. 6467 | synaptogyrin 3 | Synaptogyrin, SS, TM, PDZ, WD | 17.2 |
| 451643 | M64437 | Hs.234799 | breakpoint cluster region | RhoGEF, RhoGAP, PH, C2 | 17.2 |
| 434518 | H56995 | Hs. 37372 | *Homo sapiens* DNA binding pepti | SS | 16.9 |
| 413244 | AW955951 | Hs. 159265 | kruppel-related zinc finger pr | SS, TM, BTB, Pep_M12B_propep | 16.3 |

TABLE 17A-continued

| Pkey | ExAccn | UniGene ID | Unigene Title | Pred Protein Dom. | R1 |
|---|---|---|---|---|---|
| 456642 | AW451623 | Hs.109752 | putative c-Myc-responsive | | 16.2 |
| 421612 | AF161254 | Hs. 106196 | 8D6 antigen | Idl_recept_a, SS, TM | 16.0 |
| 456177 | NM_012391 | Hs.79414 | prostate epithelium-specific E | Ets, SAM_PNT | 15.7 |
| 409261 | BE315042 | Hs. 19210 | hypothetical protein MGC11308 | | 15.6 |
| 414837 | U24266 | Hs. 77448 | aldehyde dehydrogenase 4 famil | aldedh | 15.6 |
| 401278 | | | Target Exon | Band_41 | 15.4 |
| 444804 | AI084452 | Hs. 22158 | hypothetical protein FLJ21988 | SS | 15.4 |
| 406620 | M81105 | Hs. 146550 | myosin, heavy polypeptide 9, n | myosin_head, Myosin_tail, l | 15.1 |
| 421495 | AI583067 | Hs. 149152 | ESTs, Weakly similar to RHOP M | | 15.0 |
| 416893 | AA455588 | Hs.62406 | hypothetical protein FLJ22573 | SS, rrm, SS | 15.0 |
| 442620 | C00138 | Hs. 8535 | Homo sapiens mRNA for KIAA1668 | SS, RNA_pol_K | 14.9 |
| 406901 | M14624 | | gb: Human 4-beta-galactosyltran | | 14.6 |
| 416006 | AA324251 | Hs. 78950 | branched chain keto acid dehyd | E1_dehydrog | 14.6 |
| 455557 | AW995839 | | gb QV4-BN0044-110200-108-h07 B | Metallophos | 14.4 |
| 416819 | U77735 | Hs. 80205 | pim-2 oncogene | pkinase, SS, TM, OTU, K_tetra | 14.3 |
| 444441 | AW613841 | Hs. 301394 | hypothetical protein MGC3101 | | 14.0 |
| 406918 | M88357 | | gb Homo sapiens DNA-binding pr | zf-C2H2, SS | 14.0 |
| 407605 | W03512 | Hs. 6479 | hypothetical protein MGC13272 | SS, Sema, pkinase, TIG, PSI, e | 13.6 |
| 447304 | Z98883 | Hs. 18079 | phosphatidylinositol glycan, c | SS, Peptidase_C2 | 13.6 |
| 402365 | | | Target Exon | SS, SS, TM, ig | 13.4 |
| 407767 | W15398 | Hs.38628 | hypothetical protein | SS, zf-CCCH | 13.3 |
| 432931 | AF174487 | Hs.293753 | Bcl-2-related ovarian killer p | | 12.7 |
| 439233 | AA831893 | Hs. 292767 | hypothetical protein FLJ23109 | zf-C3HC4, TM, Sulfate_trans | 12.7 |
| 423801 | NM_015071 | Hs.132942 | GTPase regulator associated wi | RhoGAP, SH3, PH | 12.6 |
| 430397 | AI924533 | Hs. 105607 | bicarbonate transporter relate | HCO3_cotransp, SS, TM | 12.6 |
| 411570 | BE144584 | Hs. 314341 | ESTs | | 12.5 |
| 400206 | | | Eos Control | SS, SS, Glyco_tranf_43, COLF | 12.3 |
| 457941 | AI004525 | Hs. 14587 | ESTs, Weakly similar to AF1518 | SS, TM, SS, TM | 12.2 |
| 412674 | X04106 | Hs.74451 | calpain 4, small subunit (30 K) | efhand, SS, CAP_GLY | 12.0 |
| 400460 | | | C11002253*: gi|129091|sp|P23267 | SS, TM, SCAN, zf-C2H2, KRAB | 12.0 |
| 417595 | AA424317 | Hs.6259 | KIAA1698 protein | SS, TM, Glyco_hydro_31, Glyc | 11.6 |
| 428758 | AA433988 | Hs.98502 | CA125 antigen; mucin 16 | SS | 11.5 |
| 424707 | BE061914 | Hs.10844 | Homo sapiens cDNA FLJ14476 fis | SS, SS, TM, Sema | 11.5 |
| 444359 | AI697160 | Hs. 143594 | ESTs, Weakly similar to HS4L_H | | 11.5 |
| 435158 | AW663317 | Hs. 65588 | DAZ associated protein 1 | rrm, SS, rrm | 11.3 |
| 407688 | W25317 | Hs.37616 | Human D9 splice variant B mRNA | | 11.3 |
| 450503 | R35917 | Hs. 301338 | hypothetical protein FLJ12587 | SS | 11.2 |
| 427448 | BE246449 | Hs.2157 | Wiskott-Aldrich syndrome (ecze | WH1, PBD, WH2, SS | 11.2 |
| 406230 | | | Target Exon | | 11.2 |
| 432143 | AL040183 | Hs. 123484 | Homo sapiens, clone IMAGE: 4178 | SS, TM, cys_rich_FGFR | 11.2 |
| 433573 | AF234887 | Hs.57652 | cadherin, EGF LAG seven-pass G | SS, TM, 7tm_2, EGF, cadherin, | 11.1 |
| 413726 | AJ278465 | Hs.75510 | annexin A11 | annexin, SS, annexin | 11.1 |
| 431974 | AW972689 | Hs.200934 | ESTs | bZIP | 11.0 |
| 428167 | AA770021 | Hs.16332 | ESTs | SS, ig, fn3 | 11.0 |
| 450461 | BE408081 | Hs.46736 | hypothetical protein FLJ23476 | SS | 10.9 |
| 412738 | N34731 | Hs. 74562 | siah binding protein 1, FBP in | homeobox | 10.9 |
| 445434 | BE391690 | Hs. 9265 | hypothetical protein FLJ20917 | SS, PWWP, Exonuclease, lipoc | 10.9 |
| 444008 | BE544855 | Hs. 236572 | ESTs, Weakly similar to SFR4_H | SS, SS, SAC3_GANP | 10.7 |
| 444410 | BE387360 | Hs. 33719 | ESTs, Moderately similar to S6 | SS | 10.6 |
| 444607 | AW405635 | Hs.293687 | ESTs | SS, PI-PLC-X, PH, PI-PLC-Y, C | 10.6 |
| 404333 | | | C7001735* gi|7768636|dbj|BAA95 | vwd | 10.5 |
| 401210 | | | C12000519: gi|7710046|ref|NP_05 | | 10.5 |
| 434743 | AI363410 | | ribosomal protein S18 | SS, TM | 10.4 |
| 434030 | AW162336 | Hs.3709 | low molecular mass ubiquinone- | SS | 10.4 |
| 450029 | AW073380 | Hs. 267963 | hypothetical protein FLJ10535 | SS, Pyndox_oxidase, zf-C2H | 10.4 |
| 439632 | AW410714 | Hs. 334437 | hypothetical protein MGC4248 | SS, TM, transmembrane4 | 10.3 |
| 438185 | Y19188 | Hs. 320461 | ESTs | SS | 10.2 |
| 432031 | AF039196 | Hs.272367 | hairless protein (putative sin | jmjC | 10.2 |
| 405371 | | | NM_005569* Homo sapiens LIM do | pkinase, LIM, PDZ | 10.1 |
| 456741 | W37608 | Hs. 184492 | ESTs | SS, pkinase | 10.1 |
| 458130 | AA115811 | Hs. 6838 | ras homolog gene family, membe | ras, arf | 10.0 |
| 456977 | AK000252 | Hs. 169758 | hypothetical protein FLJ20245 | | 10.0 |
| 420029 | BE258876 | Hs. 94446 | polyamine-modulated factor 1 | aldo_ket_red, SS, TM, gla | 10.0 |
| 445625 | BE246743 | | hypothetical protein FLJ22635 | SS, TM | 9.9 |
| 423366 | Z80345 | Hs. 127610 | acyl-Coenzyme A dehydrogenase, | Acyl-CoA_dh, Acyl-CoA_dh_M | 9.8 |
| 458216 | AW024282 | Hs.104938 | hypothetical protein MGC15906 | | 9.8 |
| 451721 | NM_006946 | Hs. 26915 | spectrin, beta, non-erythrocyt | spectrin, PH, CH, SS, Peptida | 9.7 |
| 421445 | AA913059 | Hs. 104433 | Homo sapiens, clone IMAGE 4054 | asp, SS, TM, ion_trans, K_tet | 9.7 |
| 431354 | BE046956 | Hs. 251673 | DNA (cytosine-5-)-methyltransf | SS, PWWP, PHD | 9.7 |
| 443780 | NM_012068 | Hs. 9754 | activating transcription facto | bZIP, NTP_transf_2, SS, TBC | 9.7 |
| 448133 | AA723157 | Hs.73769 | folate receptor 1 (adult) | Folate_rec, SS | 9.7 |
| 444202 | AL031685 | Hs. 12785 | KIAA0939 protein | SS, TM, Na_H_Exchanger, ABC2 | 9.7 |
| 427640 | AF058293 | Hs. 180015 | D-dopachrome tautomerase | MIF, late_protein_L2, SS, GS | 9.6 |
| 419167 | AI589535 | Hs.94875 | ESTs, Weakly similar to A35363 | SS | 9.6 |
| 424618 | L29472 | Hs. 1802 | major histocompatibility compl | TM, ig, MHC_II_beta, SS, TM, A | 9.6 |
| 427497 | AW139476 | Hs. 31240 | ESTs | | 9.6 |
| 420423 | AA827718 | Hs. 88218 | ESTs | SS | 9.6 |

TABLE 17A-continued

| Pkey | ExAccn | UniGene ID | Unigene Title | Pred Protein Dom. | R1 |
|---|---|---|---|---|---|
| 414756 | AW451101 | Hs. 159489 | ESTs, Moderately similar to JC | hexokinase2, hexokinase | 9.6 |
| 407893 | BE408359 | Hs.43621 | Homo sapiens, Similar to hypot | SS, SS, arf, ras, fn3, ras | 9.5 |
| 408294 | BE141732 | | gb QV0-HT0101-061099-032-e07 H | Ammonium_transp | 9.5 |
| 442232 | AI357813 | Hs. 337460 | ESTs, Weakly similar to A47582 | SS, TM, TGFb_propeptide, TGF | 9.4 |
| 416866 | AA297356 | Hs. 80324 | serine/threonine protein phosp | Metallophos, Metallophos | 9.4 |
| 419823 | AW271708 | Hs. 118918 | ESTs, Weakly similar to M2OM_H | SS, TM | 9.4 |
| 422625 | AW504698 | Hs.155976 | cullin 4B | SS, SS, Cullin, Cullin | 9.3 |
| 401264 | | | C18000090* gi|6678656|ref|NP_0 | SS, laminin_Nterm, laminin_ | 9.3 |
| 407507 | U73799 | | gb Human dynactin mRNA, partia | SS, TM, HCO3_cotransp, CAP_G | 9.2 |
| 400833 | | | C11000890: gi|3746443|gb|AAC639 | SS, SS, 7tm_1 | 9.2 |
| 422064 | AW452589 | Hs. 335742 | ESTs | TM | 9.2 |
| 452434 | D30934 | Hs.29549 | C-type lectin-like receptor-1 | lectin_c, SS, TM | 9.2 |
| 421363 | NM_001381 | Hs. 103854 | docking protein 1, 62 kD (downs | PH, IRS, TM, PH, IRS, trypsin, | 9.1 |
| 427397 | AI929685 | Hs. 177656 | calmodulin 1 (phosphorylase ki | efhand, RrnaAD, SS, efhand | 9.1 |
| 431462 | AW583672 | Hs.256311 | granin-like neuroendocrine pep | SS | 9.0 |
| 434796 | AA812046 | | ESTs | SS, myb_DNA-binding, myb_DN | 9.0 |
| 422639 | AI929377 | Hs.173724 | creatine kinase, brain | ATP-gua_Ptrans, ATP-gua_Pt | 9.0 |
| 447867 | AI525268 | Hs. 164303 | ESTs | TM | 9.0 |
| 442472 | AW806859 | | gb MR0-ST0020-081199-004-c03 S | SS, TM, Inos-1-P_synth, Occl | 8.9 |
| 455588 | AI129903 | Hs. 74669 | vesicle-associated membrane pr | synaptobrevin, SS, TM | 8.9 |
| 454319 | AW247736 | Hs. 101617 | ESTs, Weakly similar to T32527 | SS | 8.9 |
| 429527 | AA454184 | Hs. 289014 | ESTs | | 8.9 |
| 432603 | AA554920 | Hs. 105794 | UDP-glucose glycoprotein gluco | SS, TM | 8.9 |
| 410338 | W03445 | Hs. 38205 | gb za05g11.r1 Soares melanocyt | pkinase | 8.9 |
| 452833 | BE559681 | Hs. 30736 | KIAA0124 protein | WD40 | 8.9 |
| 407363 | AF035032 | Hs. 181125 | gb Homo sapiens clone MCA1L my | SS, ig, SS, G_glu_transpept | 8.8 |
| 414413 | BE294877 | | gb: 601174162F1 NIH_MGC_17 Homo | SS | 8.8 |
| 431765 | AF124249 | Hs. 268541 | novel SH2-containing protein 1 | SH2, SS, TM | 8.8 |
| 421694 | BE387430 | Hs. 106880 | bystin-like | | 8.8 |
| 453683 | AL079854 | Hs. 118598 | Homo sapiens mRNA for KIAA1878 | SS | 8.8 |
| 418736 | T18979 | Hs. 87908 | Snf2-related CBP activator pro | SS, helicase_C, AT_hook, SS, | 8.7 |
| 450958 | AL137669 | Hs.348012 | Homo sapiens mRNA; cDNA DKFZp4 | | 8.7 |
| 419725 | U66048 | Hs. 92683 | Homo sapiens clone 161455 brea | | 8.7 |
| 415126 | D60945 | | gb HUM141D04B Clontech human f | SS, TM | 8.7 |
| 406301 | | | Target Exon | TM | 8.6 |
| 418843 | AJ251016 | Hs. 89230 | potassium intermediate/small c | TM, CaMBD, SK_channel, TM | 8.6 |
| 433396 | AI742071 | Hs.133205 | ESTs | SS, TM | 8.6 |
| 434333 | AA186733 | Hs.292154 | stromal cell protein | | 8.6 |
| 407065 | Y10141 | | gb: H. sapiens DAT1 gene, partia | SNF, SS, TM | 8.6 |
| 452851 | AW173191 | Hs. 213117 | ESTs | SS, Sema | 8.6 |
| 422418 | AK001383 | Hs. 116385 | hypothetical protein FLJ10521 | RhoGEF | 8.6 |
| 447859 | AK002194 | Hs.19851 | peroxisomal biogenesis factor | | 8.6 |
| 420836 | AW958453 | Hs. 204959 | hypothetical protein FLJ14886 | SS, ras | 8.6 |
| 429099 | BE439952 | Hs. 196177 | phosphorylase kinase, gamma 2 | pkinase, SS, SNF2_N, helicas | 8.6 |
| 419639 | AK001502 | Hs. 91753 | hypothetical protein | | 8.6 |
| 429712 | AW245825 | Hs. 211914 | ENSP00000233627* NADH-ubiquino | oxidored_q6, SS, TM, rrm | 8.5 |
| 452554 | AW452434 | Hs. 58006 | ESTs, Weakly similar to ALU5_H | SS, PAS, HLH | 8.5 |
| 441076 | N49809 | Hs.11197 | Homo sapiens, clone IMAGE 3343 | | 8.5 |
| 428860 | U38291 | Hs. 194301 | microtubule-associated protein | M | 8.5 |
| 421901 | AB014554 | Hs. 109299 | protein tyrosine phosphatase, | SAM, SS, TM, rrm, PDZ | 8.4 |
| 441363 | AW450211 | Hs. 126825 | ESTs, Weakly similar to A46302 | SS, TM, HSP70, 7tm_1 | 8.4 |
| 443801 | AW206942 | Hs.253456 | intron of: trichorhinophalang | GATA | 8.4 |
| 432862 | AW004958 | Hs. 236720 | amnionless protein | SS, MATH, zf-TRAF, zf-C3HC4 | 8.4 |
| 431849 | AI670823 | Hs. 85573 | hypothetical protein MGC10911 | SS, TM | 8.4 |
| 423662 | AK001035 | Hs. 130881 | B-cell CLL/lymphoma 11A (zinc | SS | 8.3 |
| 404365 | | | Target Exon | SS | 8.3 |
| 425694 | U51333 | Hs. 159237 | hexokinase 3 (white cell) | hexokinase, hexokinase2, he | 8.3 |
| 423098 | AA321980 | Hs. 204682 | ESTs | | 8.3 |
| 434552 | AA639618 | Hs. 325116 | Homo sapiens, clone MGC: 2962, | SS | 8.2 |
| 418361 | AW505368 | Hs.12460 | gb: UI-HF-BN0-alu-d-03-0-UI r1 | | 8.2 |
| 427433 | D82070 | Hs. 177972 | chromosome 4 open reading fram | SS, pkinase | 8.2 |
| 420138 | BE268854 | Hs. 177729 | ESTs | SS | 8.2 |
| 426391 | AW161050 | Hs. 169611 | second mitochondria-derived ac | SS | 8.1 |
| 457613 | AA598869 | Hs. 173770 | ESTs | | 8.1 |
| 427502 | AI811865 | Hs.7133 | Homo sapiens, clone IMAGE 3161 | SS, TM, ABC_tran, Glyco_tran | 8.1 |
| 437215 | AL117488 | | Human clone 23564 mRNA sequenc | SS | 8.1 |
| 423384 | AL133632 | Hs. 127808 | Homo sapiens mRNA; cDNA DKFZp4 | | 8.1 |
| 447151 | AI022813 | Hs. 92679 | Homo sapiens clone CDABP0014 m | SS, TM, LRR, aminotran_1_2 | 8.0 |
| 431898 | AK000020 | Hs.272018 | hypothetical protein FLJ20013 | | 8.0 |
| 454291 | AW384847 | Hs. 213534 | ESTs, Weakly similar to MUC2_H | SS, XRCC1_N, BRCT, lactamase | 8.0 |
| 430354 | AA954810 | Hs. 239784 | human homolog of Drosophila Sc | SS, TM, ig | 8.0 |
| 459302 | NM_002314 | Hs. 36566 | LIM domain kinase 1 | | 8.0 |
| 422765 | AW409701 | Hs.1578 | baculoviral IAP repeat-contain | BIR, TK, SS, TM | 8.0 |
| 425944 | AK000664 | Hs.164256 | hypothetical protein FLJ20657 | | 7.9 |
| 450873 | BE464016 | Hs. 238956 | ESTs | SS, zf-C2H2, rrm | 7.9 |
| 454246 | AW245185 | Hs. 6996 | ESTs | | 7.9 |
| 450635 | AW403954 | Hs. 25237 | mesenchymal stem cell protein | 4HBT | 7.9 |

TABLE 17A-continued

| Pkey | ExAccn | UniGene ID | Unigene Title | Pred Protein Dom. | R1 |
|---|---|---|---|---|---|
| 422305 | AI928242 | Hs. 293438 | ESTs, Highly similar to AF1984 | SS | 7.9 |
| 425760 | D17629 | Hs. 159479 | galactosamine (N-acetyl)-6-sul | Sulfatase, SS, TM | 7.9 |
| 413534 | BE146961 | | gb: QV4-HT0222-011199-019-b12 H | SS, TM | 7.8 |
| 446931 | AI348856 | Hs.21627 | gb: tb02a05.x2 NCI_CGAP_Lu26 Ho | | 7.8 |
| 421726 | AK001237 | Hs. 319088 | hypothetical protein FLJ10375 | TM | 7.8 |
| 427461 | AA531527 | Hs. 332040 | hypothetical protein MGC13010 | SS, TM, ACAT, LRR | 7.8 |
| 448993 | AI471630 | | KIAA0144 gene product | | 7.8 |
| 443136 | NM_001440 | Hs. 9018 | exostoses (multiple)-like 3 | Exostosin, SS, TM | 7.8 |
| 427725 | U66839 | Hs. 180533 | mitogen-activated protein kina | pkinase | 7.8 |
| 400923 | | | Target Exon | SS, TM, DUF289 | 7.8 |
| 419757 | AA773820 | Hs.63970 | ESTs | SS, TM | 7.8 |
| 458834 | AI566883 | Hs. 196446 | ESTs | | 7.8 |
| 427899 | AA829286 | Hs. 332053 | serum amyloid A1 | SS, SAA_proteins, SS, SAA_pr | 7.7 |
| 452399 | BE513301 | Hs. 29344 | hypothetical protein, clone 24 | SS, perilipin | 7.7 |
| 436543 | NM_002212 | Hs. 5215 | integrin beta 4 binding protei | eIF6 | 7.7 |
| 431811 | AB040972 | Hs.301696 | hypothetical protein FLJ11560 | SS, TM, Band_7, AAA, cdc48_N, | 7.7 |
| 414534 | BE257293 | Hs. 76366 | BCL2-antagonist of cell death | SS, hormone_rec, zf-C4 | 7.7 |
| 455885 | BE153524 | | gb PM0-HT0339-241199-002-C03 H | SS, pkinase | 7.7 |
| 427721 | AI582843 | Hs. 180455 | RAD23 (S. cerevisiae) homolog | ubiquitin, UBA, integrin_B, | 7.6 |
| 430432 | AB037758 | Hs. 241419 | KIAA1337 protein | TM, Patched, TM | 7.6 |
| 427273 | AW139032 | Hs.107376 | hypothetical protein DKFZp434N | SS, SS, TM | 7.6 |
| 450334 | AF035959 | Hs. 24879 | phosphatidic acid phosphatase | PAP2, SS | 7.6 |
| 413564 | BE260120 | | gb 601146990F1 NIH_MGC_19 Homo | | 7.6 |
| 410397 | AF217517 | Hs.63042 | DKFZp564J157 protein | SS, homeobox, UPF0160, DUF23 | 7.6 |
| 439539 | BE348395 | Hs. 121589 | ESTs | SS, Fork_head | 7.5 |
| 400286 | | | C16000922 gi|7499103|pir||T209 | TM, ABC_tran, ABC_membrane | 7.5 |
| 416472 | AA180756 | Hs. 340316 | ESTs, Moderately similar to AL | zf-C2H2 | 7.5 |
| 418641 | BE243136 | Hs. 86947 | a disintegrin and metalloprote | disintegrin, Reprolysin, Pe | 7.5 |
| 419492 | AA243547 | Hs.19447 | PDZ-LIM protein mystique | LIM, SS, SH3, Sorb, Metalloph | 7.5 |
| 420970 | AA305079 | Hs.1342 | cytochrome c oxidase subunit V | COX5B | 7.5 |
| 406495 | | | Target Exon | SRCR, TM, Acetyltransf | 7.5 |
| 448043 | AI458653 | Hs. 201881 | ESTs | PHD | 7.4 |
| 401724 | | | C16001374 gi|6755086|ref|NP_03 | TM, PLAT, SS | 7.4 |
| 424263 | M77640 | Hs. 1757 | L1 cell adhesion molecule (hyd | fn3, ig, IRK, SS, TM, fn3, ig, R | 7.4 |
| 428092 | AW879141 | | ESTs | SS, TM | 7.3 |
| 453023 | AW028733 | Hs. 31439 | serine protease inhibitor, Kun | Kunitz_BPTI, SS, TM, ion_tra | 7.3 |
| 400137 | | | Eos Control | | 7.3 |
| 436127 | W94824 | Hs.11565 | RIKEN cDNA 2010100O12 gene | Corona_7, SS, TM | 7.3 |
| 412265 | AA101325 | Hs. 86154 | hypothetical protein FLJ12457 | UPP_synthetase, HMG14_17 | 7.3 |
| 432747 | NM_014404 | Hs. 278907 | calcium channel, voltage-depen | PMP22_Claudin, SS, TM, PMP22 | 7.3 |
| 448859 | BE272446 | Hs.265317 | hypothetical protein MGC2562 | SS, TPR | 7.3 |
| 407619 | AL050341 | Hs. 37165 | collagen, type IX, alpha 2 | SS, Collagen, SS, Collagen | 7.3 |
| 429299 | AI620463 | Hs. 347408 | hypothetical protein MGC13102 | SS, TM, gla | 7.3 |
| 401674 | | | C16001417* gi|7500345|pir||T21 | FAD-oxidase_C, FAD_binding | 7.2 |
| 412289 | AW935967 | Hs. 170162 | KIAA1357 protein | SS | 7.2 |
| 424198 | AB029010 | Hs.143026 | KIAA1087 protein | SS, TM, Na_Ca_Ex, Calx-beta, | 7.2 |
| 412173 | T71071 | | gb yc50b05.r1 Stratagene liver | CPSase_L_chain | 7.2 |
| 438113 | AI467908 | Hs.8882 | ESTs | SS, TM, 7tm_1 | 7.2 |
| 429869 | AI907018 | Hs. 15977 | Target CAT | rrm | 7.2 |
| 439963 | AW247529 | Hs. 6793 | platelet-activating factor ace | PAF-AH_Ib, Lipase_GDSL, SS, | 7.2 |
| 425041 | AI377150 | Hs.150914 | ESTs | SS | 7.2 |
| 448340 | AI492910 | Hs. 32362 | ESTs | | 7.1 |
| 406779 | AA412048 | Hs. 279574 | CGI-39 protein, cell death-reg | SS, SS | 7.1 |
| 431005 | AA490544 | Hs. 127269 | ESTs, Weakly similar to T02345 | WD40 | 7.1 |
| 421273 | AJ245416 | Hs. 103106 | U6 snRNA-associated Sm-like pr | Sm, SS, tRNA-synt_1, GST_C, G | 7.1 |
| 409746 | AA159216 | Hs. 55505 | hypothetical protein FLJ20442 | Y_phosphatase, DSPc, TM | 7.0 |
| 430281 | AI878842 | Hs.237924 | CGI-69 protein | mito_carr, SS, TM | 7.0 |
| 444672 | Z95636 | Hs.11669 | laminin, alpha 5 | laminin_EGF, laminin_G, EGF | 7.0 |
| 405928 | | | Target Exon | SS, cystatin, Coprogen_oxid | 7.0 |
| 421321 | NM_005309 | Hs. 103502 | glutamic-pyruvate transaminase | aminotran_1_2, SS, TM, LRR | 6.9 |
| 439905 | AW799755 | Hs. 110953 | retinoic acid induced 1 | HLH | 6.9 |
| 451937 | AF119664 | Hs. 27299 | transcriptional regulator prot | SS, integrin_B, fn3, Calx-be | 6.9 |
| 426675 | AW084791 | Hs.133122 | hypothetical protein FLJ14524 | SS, TM, aminotran_1_2 | 6.9 |
| 438627 | AI087335 | Hs. 123473 | ESTs | TM, Reticulon | 6.9 |
| 438951 | U51336 | Hs. 6453 | inositol 1,3,4-triphosphate 5/ | SS, oxidored_nitro, SS | 6.8 |
| 421758 | BE397336 | Hs.1422 | Gardner-Rasheed feline sarcoma | SH2, SH3, pkinase | 6.8 |
| 423228 | AL137491 | Hs. 125511 | Homo sapiens mRNA, cDNA DKFZp4 | SS, TM, sushi | 6.8 |
| 405346 | | | Rag C protein | RCC1 | 6.8 |
| 432746 | AA564512 | Hs. 24301 | polymerase (RNA) II (DNA direc | SS, TM, EF1BD | 6.8 |
| 452798 | AI918771 | Hs.257170 | ESTs | SS, TM, TNFR_c6 | 6.7 |
| 426315 | AA854219 | Hs. 348137 | Homo sapiens, clone IMAGE 3542 | SS, crystall | 6.7 |
| 440317 | BE561888 | | gb 601346093F1 NIH_MGC_8 Homo | | 6.7 |
| 438857 | AI627912 | Hs. 130783 | Forssman synthetase | SS, RA, RasGEF, RasGEFN | 6.7 |
| 452072 | BE258857 | Hs. 27744 | RAB3A, member RAS oncogene fam | ras, arf, SS, PDEase | 6.7 |
| 433938 | AF161536 | Hs. 284292 | ubiquinol-cytochrome c reducta | TM | 6.7 |
| 423106 | N52572 | Hs. 13702 | ESTs, Moderately similar to AL | | 6.7 |
| 453101 | AW952776 | Hs.94943 | ESTs | TM | 6.7 |

TABLE 17A-continued

| Pkey | ExAccn | UniGene ID | Unigene Title | Pred Protein Dom. | R1 |
|---|---|---|---|---|---|
| 420307 | AW502869 | Hs. 66219 | ESTs | SS, TM | 6.7 |
| 415056 | AB004662 | Hs. 77867 | adenosine A1 receptor | 7tm_1, SS, TM | 6.7 |
| 454262 | AW612232 | Hs.254835 | ESTs | SS, TM, voltage_CLC, CBS | 6.7 |
| 409227 | AA806165 | Hs. 130323 | *Homo sapiens*, clone IMAGE: 3960 | | 6.6 |
| 413908 | BE409966 | Hs.323813 | *Homo sapiens*, clone MGC 2867 | SS, zf-C2H2 | 6.6 |
| 457274 | AW674193 | Hs.227152 | mannan-binding lectin senne p | SS, TM, SS, TM, Clathrin_lg_c | 6.6 |
| 419157 | AA234540 | Hs. 23871 | ESTs | pkinase | 6.6 |
| 431424 | AI222969 | | ESTs | SS | 6.6 |
| 412464 | T78141 | Hs. 22826 | ESTs, Weakly similar to I55214 | SS, cadherin, crystall | 6.6 |
| 430168 | AW968343 | | DKFZP434I1735 protein | SS, TM, efhand, efhand | 6.6 |
| 455035 | AW851734 | | gb MR2-CT0222-011199-007-e10 C | | 6.6 |
| 422682 | W05238 | Hs.94316 | ESTs, Weakly similar to T31613 | SS, TM, DEAD, helicase_C, Lam | 6.6 |
| 453367 | AW732847 | Hs. 70573 | PKCI-1-related HIT protein | SS, TM | 6.6 |
| 450593 | AF129085 | Hs. 25197 | STIP1 homology and U-Box conta | TPR, SS, TM, Rhomboid, lactam | 6.6 |
| 420319 | AW406289 | Hs. 96593 | hypothetical protein | ras.arf | 6.6 |
| 431131 | N84730 | Hs. 250616 | isocitrate dehydrogenase 3 (NA | isodh, isodh | 6.6 |
| 431297 | AA651771 | Hs. 3076 | ESTs | | 6.6 |
| 410082 | AA081594 | Hs.158311 | Musashi (Drosophila) homolog 1 | SS, HECT, phoslip | 6.5 |
| 441307 | AW071696 | Hs. 209065 | hypothetical protein FLJ14225 | SS, TM | 6.5 |
| 454682 | AW816029 | | gb: MR3-ST0220-151299-027-b10 S | filament | 6.5 |
| 407299 | AA460205 | Hs. 289770 | ESTs, Weakly similar to I38022 | | 6.5 |
| 422837 | U25441 | Hs.121478 | dopamine receptor D3 | 7tm_1, SS, TM,7tm_1 | 6.5 |
| 407722 | BE252241 | Hs. 38041 | pyridoxal (pyridoxine, vitamin | pfkB, SS | 6.4 |
| 417810 | D28419 | Hs. 82609 | hydroxymethylbilane synthase | Porphobil_deam | 6.4 |
| 445333 | BE537641 | Hs. 44278 | hypothetical protein FLJ12538 | SS | 6.4 |
| 402197 | | | Target Exon | SS, TM, ATP1G1_PLM_MAT8, ig, | 6.3 |
| 419390 | AI701162 | Hs.90207 | hypothetical protein MGC11138 | SS, TM, PMP22_Claudin, PMP22 | 6.3 |
| 447754 | AW073310 | Hs.163533 | intron of HER4 | | 6.3 |
| 444664 | N26362 | Hs.11615 | map kinase phosphatase-like pr | DSPc, Rhodanese, SS, TM | 6.3 |
| 421190 | U95031 | Hs. 102482 | mucin 5, subtype B, tracheobro | Cys_knot, vwc | 6.3 |
| 432872 | AI908984 | Hs. 279623 | selenoprotein X, 1 | DUF25, SS, Ribosomal_L3, PDZ | 6.3 |
| 430023 | AA158243 | Hs. 227729 | FK506-binding protein 2 (13 kD) | SS, FKBP, SS, PDGF, C2, PI-PLC | 6.3 |
| 413343 | BE392026 | Hs.334346 | hypothetical protein MGC13045 | SS, DnaJ | 6.2 |
| 417852 | AJ250562 | Hs. 82749 | transmembrane 4 superfamily me | transmembrane4, SS, TM | 6.2 |
| 403128 | | | KIAA1033 protein | SS, TM, tubulin, EGF, F5_F8_t | 6.2 |
| 413055 | AV655701 | Hs. 75183 | cytochrome P450, subfamily IIE | p450 | 6.2 |
| 427812 | AA770424 | Hs. 98162 | ESTs | SS | 6.2 |
| 457761 | AW401809 | Hs. 4779 | KIAA1150 protein | SS, LIM, SS | 6.2 |
| 453099 | H62087 | Hs. 31659 | thyroid hormone receptor-assoc | SS | 6.2 |
| 426048 | AI768853 | Hs. 134478 | ESTs | TM | 6.2 |
| 407223 | H96850 | | gb yw03b12 s 1 Soares melanocyt | SS, TM, SS, TM, DDOST_48 kD | 6.2 |
| 445634 | AI624849 | Hs. 344612 | ESTs, Weakly similar to NEL1_H | vwd | 6.2 |
| 441197 | BE244638 | Hs. 166 | sterol regulatory element bind | HLH | 6.1 |
| 421707 | NM_014921 | Hs. 107054 | lectomedin-2 | Latrophilin, OLF,7tm_2, Gal | 6.1 |
| 435750 | AB029012 | Hs. 4990 | KIAA1089 protein | SS, TM | 6.1 |
| 432353 | NM_016558 | Hs. 274411 | SCAN domain-containing 1 | SCAN | 6.1 |
| 427854 | AI287878 | | gb qv23f06 x1 NCI_CGAP_Lym6 Ho | SS, TM, 7tm_1, SS, TM | 6.1 |
| 447128 | AI271898 | | cyclin K | | 6.1 |
| 419444 | NM_002496 | Hs. 90443 | Target CAT | fer4, SS, TM, V_ATPase_sub_a | 6.1 |
| 457978 | AA776638 | | gb ae78g04 s 1 Stratagene schiz | SS, PH, IQ, RasGEF, RasGEFN, R | 6.1 |
| 410445 | AA199830 | | gb: zq75h01.r1 Stratagene hNT n | | 6.1 |
| 431857 | W19144 | Hs. 271742 | ADP-ribosyltransferase (NAD, p | PARP, PARP_reg, SS, TM, Pepti | 6.1 |
| 407143 | C14076 | Hs. 332329 | EST | SS, TM | 6.0 |
| 408724 | AI685842 | Hs.294143 | ESTs, Weakly similar to T22914 | SS, pkinase, tubulin | 6.0 |
| 436685 | W28661 | Hs. 5288 | *Homo sapiens* mRNA; cDNA DKFZp4 | SS, TM, pkinase, Activin_rec | 6.0 |
| 441583 | AI791499 | Hs. 205742 | ESTs, Weakly similar to ALUA_H | | 6.0 |
| 418802 | AB028989 | Hs. 88500 | mitogen-activated protein kina | WD40, Pico_P2A, M, SS | 6.0 |
| 414927 | T83587 | Hs. 186476 | ESTs | SS, Sulfatase | 6.0 |
| 434314 | BE392921 | Hs.3797 | RAB26, member RAS oncogene fam | ras, arf, SS | 6.0 |
| 414157 | BE297801 | Hs. 103365 | ESTs, Moderately similar to I5 | SS | 6.0 |
| 424415 | NM_001975 | Hs. 146580 | enolase 2, (gamma, neuronal) | enolase, SS, Atrophin-1, Atr | 6.0 |
| 406487 | | | Target Exon | SS, TM | 6.0 |
| 447365 | BE383676 | Hs. 334 | Rho guanine nucleotide exchang | SH3, PH, RhoGEF | 6.0 |
| 417900 | BE250127 | Hs. 82906 | CDC20 (cell division cycle 20, | WD40, SS, TM, fn3, EGF, fn3, ig | 6.0 |
| 442297 | NM_006202 | Hs.89901 | phosphodiesterase 4A, cAMP-spe | PDEase | 5.9 |
| 426440 | BE382756 | Hs. 169902 | solute carrier family 2 (facil | sugar_tr, SS, TM, sugar_tr | 5.9 |
| 418256 | AW845318 | Hs. 12271 | f-box and leucine-rich repeat | SS, SS, TM, HSF_DNA-bind | 5.9 |
| 431543 | AW969619 | Hs. 259768 | adenylate cyclase 1 (brain) | TM | 5.9 |
| 430344 | AA476827 | Hs. 171012 | hypothetical protein FLJ22349 | HLH | 5.9 |
| 428539 | AW410063 | Hs.184877 | solute carrier family 25 (mito | mito_carr, SS, TM, profilin, | 5.9 |
| 403938 | | | Target Exon | Ephrin | 5.9 |
| 456950 | AF111170 | Hs. 306165 | *Homo sapiens* 14q32 Jagged2 gen | SS, TM, DSL | 5.9 |
| 451481 | AA300228 | Hs. 295866 | hypothetical protein DKFZp434N | | 5.9 |
| 434357 | AW732284 | Hs. 3828 | mevalonate (diphospho) decarbo | GHMP_kinases, SS, TM | 5.9 |
| 443553 | AL040535 | Hs. 9573 | ATP-binding cassette, sub-fami | ABC_tran, SS | 5.9 |
| 433333 | AI016521 | Hs. 71816 | v-akt murine thymoma viral onc | homeobox, pkinase, PH, pkina | 5.9 |
| 430600 | AW950967 | Hs. 274348 | HLA-B associated transcript-3 | ubiquitin, SS, TM, G-patch, a | 5.9 |

TABLE 17A-continued

| Pkey | ExAccn | UniGene ID | Unigene Title | Pred Protein Dom. | R1 |
|---|---|---|---|---|---|
| 409034 | AI684149 | Hs. 172035 | hypothetical protein similar t | SS | 5.9 |
| 421542 | AA411607 | Hs. 118964 | ESTs, Weakly similar to KIAA11 | SS, SS | 5.9 |
| 431534 | AL137531 | Hs. 258890 | Homo sapiens mRNA, cDNA DKFZp4 | SS, TM, ras | 5.9 |
| 409608 | AF231023 | Hs. 55173 | cadherin, EGF LAG seven-pass G | SS, TM, 7tm_2, cadherin, GPS, | 5.9 |
| 423464 | NM_016240 | Hs.128856 | CSR1 protein | Collagen, SS | 5.9 |
| 422379 | AA932860 | Hs.133864 | ESTs | | 5.8 |
| 443887 | NM_004729 | Hs. 9933 | Ac-like transposable element | zf-BED | 5.8 |
| 450122 | BE313765 | Hs. 343443 | ESTs, Weakly similar to I38022 | SS, TM, Y_phosphatase, LON, A | 5.8 |
| 404807 | | | Target Exon | UPF0027 | 5.8 |
| 445303 | AW362198 | Hs.12503 | interleukin 15 receptor, alpha | SS, sushi, SS | 5.8 |
| 445631 | AK001822 | | Homo sapiens cDNA FLJ10960 fis | | 5.8 |
| 412091 | R06185 | | gb ye94d03 r1 Soares fetal liv | SS, TM, IBR, IBR | 5.8 |
| 446536 | W74413 | Hs. 15251 | hypothetical protein | SS | 5.8 |
| 432866 | BE395875 | Hs. 279609 | mitochondrial carrier homolog | mito_carr | 5.8 |
| 402393 | | | ENSP00000085284*.CDNA FLJ20404 | RhoGEF, PH, SS, zf-CCCH, vwd | 5.8 |
| 413041 | BE061580 | Hs. 61622 | gb.MR0-BT0249-091299-201-c07 B | SS | 5.8 |
| 414356 | AW505085 | Hs. 335147 | gb.UI-HF-BN0-als-a-10-0-Ul.r1 | SS, TM | 5.8 |
| 402916 | | | ENSP00000202587* Bicarbonate t | HCO3_cotransp, SS | 5.7 |
| 459133 | U40343 | Hs.29656 | cyclin-dependent kinase inhibi | ank, SS, Adap_comp_sub | 5.7 |
| 404757 | | | Target Exon | TM, zf-C2H2 | 5.7 |
| 409879 | BE083422 | Hs. 56851 | hypothetical protein MGC2668 | SS, TM | 5.7 |
| 411219 | AW832917 | | gb: QV2-TT0003-161199-013-h06 T | | 5.7 |
| 421871 | AK001416 | Hs. 306122 | glycoprotein, synaptic 2 | TM, Steroid_dh, SS | 5.7 |
| 434067 | H18913 | Hs.124023 | Homo sapiens cDNA FLJ14218 fis | | 5.7 |
| 416759 | AK000978 | Hs. 79741 | hypothetical protein FLJ10116 | | 5.7 |
| 446562 | BE272686 | Hs. 15356 | hypothetical protein FLJ20254 | hormone, SS, pfkB | 5.7 |
| 407117 | AA146625 | | gb zo71c07 s1 Stratagene pancr | SS | 5.7 |
| 444855 | BE409261 | Hs. 12084 | Tu translation elongation fact | GTP_EFTU, GTP_EFTU_D3, GTP_ | 5.7 |
| 421543 | AK000519 | Hs. 105606 | hypothetical protein FLJ20512 | TM | 5.7 |
| 407757 | BE048414 | Hs. 165215 | hypothetical protein MGC5395 | SS, EF1G_domain, GST_C, GST_ | 5.7 |
| 419125 | AA642452 | Hs.130881 | B-cell CLL/lymphoma 11A (zinc | SS | 5.7 |
| 437141 | BE304917 | Hs. 31097 | hypothetical protein FLJ21478 | SS, TM, Glycos_transf_4 | 5.7 |
| 408905 | AV655783 | Hs. 661 | Target CAT | | 5.7 |
| 450787 | AB006190 | Hs. 25475 | aquaporin 7 | MIP, SS, TM | 5.7 |
| 432496 | D45576 | Hs.187959 | ESTs | | 5.7 |
| 429367 | AB007867 | Hs. 278311 | plexin B1 | Sema, PSI, TIG, SS, TM, TIG, Se | 5.7 |
| 422708 | AB017430 | Hs.119324 | kinesin-like 4 | kinesin, homeobox, SS, TM, zf | 5.7 |
| 417442 | AA199940 | Hs. 124039 | ESTs | | 5.7 |
| 432751 | AF152099 | Hs.278911 | interleukin 17C | SS | 5.7 |
| 432004 | BE018302 | Hs.2894 | placental growth factor, vascu | PDGF, SS | 5.7 |
| 454151 | AA047169 | Hs. 154088 | hypothetical protein FLJ22756 | SS, TM, Glycos_transf_4 | 5.7 |
| 456145 | BE299427 | Hs. 21446 | KIAA1716 protein | SS, DIX, PDZ, DEP, Dishevelle | 5.6 |
| 417677 | NM_016055 | Hs. 82389 | CGI-118 protein | | 5.6 |
| 451558 | NM_001089 | Hs. 26630 | ATP-binding cassette, sub-fami | ABC_tran, SRP54, SS, TM, ECH | 5.6 |
| 408795 | AW749126 | Hs. 170345 | hypothetical protein FLJ13710 | hormone_rec, zf-C4 | 5.6 |
| 407204 | R41933 | Hs.140237 | ESTs, Weakly similar to ALU1_H | SS, histone, histone | 5.6 |
| 452849 | AF044924 | Hs.30792 | hook2 protein | bZIP, SS, AhpC-TSA | 5.6 |
| 439343 | AF086161 | Hs. 114611 | hypothetical protein FLJ11808 | | 5.6 |
| 459271 | AL045934 | | gb: DKFZp434M116_r1 434 (synony | SS, PI3_PI4_kinase, PI3Ka | 5.6 |
| 401609 | | | C16001614: gi|7801278|emb|CAB91 | | 5.6 |
| 447827 | U73987 | Hs. 19718 | protein tyrosine phosphatase, | Y_phosphatase, fn3, ig, MAM, | 5.6 |
| 409125 | R17268 | Hs. 343567 | axonal transport of synaptic v | SS, kinesin, PH, FHA, kinesin | 5.6 |
| 450437 | X13956 | Hs.24998 | hypothetical protein MGC10471 | SS | 5.6 |
| 415514 | F11301 | Hs. 138329 | ESTs | SS, TM | 5.6 |
| 437926 | BE383605 | Hs. 300816 | small GTP-binding protein | SS, TM, TPR | 5.6 |
| 406663 | U24683 | | immunoglobulin heavy constant | SS | 5.6 |
| 421678 | AA419008 | Hs. 106730 | chromosome 22 open reading fra | SS, TM, UBA, Rhomboid, SS, TM | 5.6 |
| 422472 | R59096 | Hs. 279939 | mitochondrial carrier homolog | mito_carr | 5.6 |
| 414918 | AI219207 | Hs. 72222 | hypothetical protein FLJ13459 | SS, TM, efhand | 5.6 |
| 434906 | BE410573 | Hs.283636 | Homo sapiens, clone IMAGE 4053 | SS, TM, Exo_endo_phos, BNR, A | 5.6 |
| 414757 | U46922 | Hs. 77252 | fragile histidine triad gene | HIT | 5.6 |
| 436014 | AF281134 | Hs. 283741 | exosome component Rrp46 | RNase_PH, RNase_PH_C, SS, TG | 5.6 |
| 421696 | AF035306 | Hs. 106890 | Homo sapiens clone 23771 mRNA | | 5.6 |
| 408015 | AW136771 | Hs.244349 | epidermal differentiation comp | | 5.6 |
| 445871 | AI702901 | Hs.145582 | ESTs, Weakly similar to FOR4 M | SS, TM, efhand, efhand | 5.5 |
| 411813 | NM_014931 | Hs. 72172 | KIAA1115 protein | SS, TM, Y_phosphatase | 5.5 |
| 425098 | AW295349 | Hs. 8038 | ESTs | SS, TM | 5.5 |
| 429720 | M79091 | | gb EST01239 Subtracted Hippoca | | 5.5 |
| 453898 | AW003512 | Hs. 232770 | arachidonate lipoxygenase 3 | SS, TM, lipoxygenase, PLAT, s | 5.5 |
| 449225 | R39108 | Hs. 6777 | ESTs | SS, TM, Na_sulph_symp | 5.5 |
| 423233 | BE048021 | Hs.11067 | ESTs, Highly similar to T46395 | | 5.5 |
| 432538 | BE258332 | Hs. 278362 | male-enhanced antigen | SS, TM, AAA, Ribosomal_L2 | 5.5 |
| 408215 | BE614290 | | syntaxin 10 | SS, SS, TM, HLH, TRM, zf-CCCH | 5.5 |
| 406244 | | | Target Exon | | 5.5 |
| 436041 | AI803516 | Hs. 272891 | hippocalcin-like protein 4 | SS, efhand, TGF-beta, TGFb_p | 5.5 |
| 422013 | N92696 | Hs. 293354 | ESTs | SS, TM | 5.5 |
| 442451 | AI498080 | Hs.129616 | ESTs | SS | 5.5 |

TABLE 17A-continued

| Pkey | ExAccn | UniGene ID | Unigene Title | Pred Protein Dom. | R1 |
|---|---|---|---|---|---|
| 427859 | AA416856 | Hs. 98170 | ESTs | SS, TM, DUF60, trypsin, CUB, u | 5.5 |
| 436540 | BE397032 | Hs. 14468 | hypothetical protein MGC14226 | SS, TM | 5.5 |
| 427747 | AW411425 | Hs. 180655 | serine/threonine kinase 12 | pkinase, SS, TM, synaptobrev | 5.4 |
| 441456 | AI458911 | Hs. 127765 | ESTs | | 5.4 |
| 431630 | NM_002204 | Hs.265829 | integrin, alpha 3 (antigen CD4 | integrin_A, FG-GAP, Rhabd_g | 5.4 |
| 415976 | R43144 | Hs. 21919 | ESTs | TM | 5.4 |
| 447374 | AF263462 | Hs. 18376 | KIAA1319 protein | SS, Myosin_tail, M | 5.4 |
| 431275 | T56571 | Hs. 10041 | ESTs | SS, HLH | 5.4 |
| 404343 | | | C7002191* gi|5053028|gb|AAD388 | SS, ABC_tran | 5.4 |
| 431461 | BE299671 | Hs. 256310 | likely ortholog of mouse ZFP28 | | 5.4 |
| 421779 | AI879159 | Hs. 108219 | wingless-type MMTV integration | SS, wnt, SS | 5.4 |
| 418678 | NM_001327 | Hs. 167379 | cancer/testis antigen (NY-ESO- | SS, TM, zf-C2H2 | 5.4 |
| 457310 | W28363 | Hs. 239752 | nuclear receptor subfamily 2, | | 5.3 |
| 417193 | AI922189 | Hs. 288390 | hypothetical protein FLJ22795 | SS | 5.3 |
| 432545 | X52486 | Hs.3041 | uracil-DNA glycosylase 2 | cyclin, SS, cyclin | 5.3 |
| 456573 | AI279811 | | Homo sapiens, clone IMAGE 3953 | | 5.3 |
| 409164 | AA706639 | | gb ag90e09 r1 Stratagene hNT n | SS, TM, Hint, HH_signal, tubu | 5.3 |
| 442296 | NM_007275 | Hs. 8186 | lung cancer candidate | SS, TM, Glyco_hydro_56, Glyc | 5.3 |
| 438670 | AI275803 | Hs. 123428 | ESTs | | 5.3 |
| 400257 | | | ENSP00000000452 BAD protein (B | SS, hormone_rec, zf-C4 | 5.3 |
| 449514 | AW970440 | Hs. 23642 | protein predicted by clone 236 | SS, PX, arf, lipocalin, PHD, z | 5.3 |
| 427336 | NM_005658 | Hs. 2134 | TNF receptor-associated factor | MATH, SS, MATH, A2M_N, A2M, NT | 5.3 |
| 414551 | AI815639 | Hs. 76394 | enoyl Coenzyme A hydratase, sh | ECH, Peptidase_U7, SS, TM | 5.3 |
| 447960 | AW954377 | Hs. 26412 | ring finger protein 26 | SS, TM, Cbl_N, Cbl_N2, Cbl_N3 | 5.3 |
| 430605 | AJ245433 | Hs. 247323 | G4 protein | SS, TM, G-patch, ubiquitin, a | 5.3 |
| 456849 | AA622394 | Hs. 153177 | ribosomal protein S28 | SS, TM | 5.2 |
| 430513 | AJ012008 | Hs.241586 | G6C protein | SS, TM, GST_C, abhydrolase | 5.2 |
| 424437 | BE244700 | Hs. 147049 | cut (Drosophila)-like 1 (CCAAT | CUT, homeobox, beta-lactama | 5.2 |
| 427815 | BE072019 | Hs.12851 | phosphatidylserine synthase 2 | SS, TM, 7tm_1 | 5.2 |
| 417903 | NM_002342 | Hs.1116 | lymphotoxin beta receptor (TNF | TNFR_c6, SS | 5.2 |
| 420476 | AW575863 | Hs. 136232 | ESTs | SS, HLH | 5.2 |
| 409960 | BE261944 | | hexokinase 1 | SS, TM | 5.2 |
| 436325 | AL390088 | Hs.7393 | hypothetical protein from EURO | SS, Synapsin_C, SS | 5.2 |
| 444439 | AI458883 | Hs. 143545 | hypothetical protein MGC11303 | SS, TM, PAF-AH_p_II | 5.2 |
| 412915 | AW087727 | Hs. 74823 | NM_004541: Homo sapiens NADH de | | 5.2 |
| 418891 | NM_002419 | Hs. 89449 | mitogen-activated protein kina | SH3, pkinase, pyridoxal_deC | 5.2 |
| 430323 | U40714 | Hs. 239307 | tyrosyl-tRNA synthetase | DUF101, SS, tRNA-synt_1b, tR | 5.2 |
| 432396 | AW295956 | Hs. 11900 | hypothetical protein FLJ14972 | SS | 5.2 |
| 457843 | AW138211 | Hs. 128746 | ESTs | | 5.2 |
| 429252 | NM_004658 | Hs. 198312 | RAS protein activator like 1 ( | C2, PH, RasGAP, BTK, SS, C2, PH | 5.1 |
| 429225 | BE250337 | Hs. 198273 | Target CAT | WD40 | 5.1 |
| 412104 | AW205197 | Hs. 240951 | Homo sapiens, Similar to RIKEN | SS, TM | 5.1 |
| 449750 | H28586 | Hs. 32325 | ESTs | SS, ras | 5.1 |
| 442725 | AI935786 | Hs. 131035 | ESTs, Weakly similar to CA24_H | SS, SS, TM, PX, PH, PLDc, arres | 5.1 |
| 430390 | AB023186 | Hs.241161 | KIAA0969 protein | PH, SS, TM | 5.1 |
| 421658 | X84048 | Hs. 301760 | frequenin (Drosophila) homolog | efhand | 5.1 |
| 426928 | AF037062 | Hs. 172914 | retinol dehydrogenase 5 (11-ci | adh_short, SS, adh_short, TG | 5.1 |
| 428924 | AI016405 | Hs.98959 | ESTs, Weakly similar to JC5314 | SS, TM, lectin_c | 5.1 |
| 458876 | AI650896 | Hs. 195347 | ESTs | | 5.1 |
| 402632 | | | Target Exon | Fz, kringle, ig | 5.1 |
| 413762 | AW411479 | Hs. 848 | FK506-binding protein 4 (59 kD) | FKBP, TPR, SS | 5.1 |
| 419451 | AI907117 | Hs. 90535 | syntaxin binding protein 2 | Sed1, SS, TM | 5.1 |
| 456155 | R85182 | Hs. 7175 | ESTs, Weakly similar to AF1568 | SS | 5.1 |
| 422396 | W21872 | Hs. 7907 | ESTs, Weakly similar to T19486 | | 5.1 |
| 413983 | BE348384 | Hs. 279194 | ESTs | | 5.0 |
| 447598 | AI799968 | Hs. 199630 | ESTs | SS, TM | 5.0 |
| 425858 | AA364923 | | gb EST75602 Pineal gland II Ho | SS, TM, Peptidase_M10, fn2, h | 5.0 |
| 440511 | AF132959 | Hs.7236 | eNOS interacting protein | SS, TM, MAGE, Ribosomal_S17, | 5.0 |
| 452661 | AW449413 | Hs. 257152 | ESTs | | 5.0 |
| 412800 | AW950852 | Hs. 4598 | polymerase (DNA directed), del | homeobox, SS, efhand, hexoki | 5.0 |
| 446603 | NM_014835 | Hs.15519 | oxysterol-binding protein-rela | Oxysterol_BP, SS | 5.0 |
| 402884 | | | ENSP00000164597.PRO0566 | laminin_Nterm, laminin_Nte | 5.0 |
| 448680 | AW245890 | Hs. 21753 | JM5 protein | WD40, SS, TM, KOW, HLH | 5.0 |
| 431515 | NM_012152 | Hs. 258583 | endothelial differentiation, I | 7tm_1 | 5.0 |
| 427204 | AA405404 | Hs. 215725 | ESTs | SS, SS | 5.0 |
| 425169 | AW292500 | Hs. 128514 | ESTs | SS | 5.0 |
| 412940 | BE295701 | Hs. 819 | homeo box B7 | homeobox, SS, homeobox, home | 5.0 |
| 440839 | AI142078 | Hs. 135562 | ESTs | SS | 5.0 |
| 443814 | BE281240 | Hs. 9857 | carbonyl reductase | | 5.0 |
| 434243 | AA628062 | Hs.200358 | ESTs, Moderately similar to AL | SS, TM | 5.0 |
| 435605 | AF151815 | Hs. 4973 | hypothetical protein | SS, TM, SS, TM, ABC_tran, ABC_ | 5.0 |
| 417116 | Z43916 | Hs. 7634 | hypothetical protein FLJ12287 | SS, TM, filament, IF_tail | 5.0 |
| 403055 | | | C2002219*: gi|12737280|ref|XP_0 | | 5.0 |
| 420856 | BE513294 | Hs.205736 | HLA class II region expressed | kazal, SS, TM, ig, pkinase | 4.9 |
| 405594 | | | NM_021949 Homo sapiens ATPase, | E1-E2_ATPase, Hydrolase, SS | 4.9 |
| 405334 | | | Target Exon | SS, TM, MIP | 4.9 |
| 419493 | AF001212 | Hs. 90744 | proteasome (prosome, macropain | PCI, SS, CDK5_activator | 4.9 |

TABLE 17A-continued

| Pkey | ExAccn | UniGene ID | Unigene Title | Pred Protein Dom. | R1 |
|---|---|---|---|---|---|
| 413764 | BE162704 | | gb PM1-HT0454-301299-001-d08 H | SS | 4.9 |
| 409169 | F00991 | Hs. 50889 | (clone PWHLC2-24) myosin light | | 4.9 |
| 446933 | AL137659 | Hs. 297214 | HSPC141 protein | SS, TM, ank, EGF, notch, MATH, | 4.9 |
| 409139 | AI681917 | Hs.3321 | ESTs, Highly similar to IRX1_H | SS, homeobox | 4.9 |
| 456672 | AK002016 | Hs. 114727 | *Homo sapiens*, clone MGC: 16327, | SS, PK, PK_C, myosin_head, Rh | 4.9 |
| 420842 | AI083668 | Hs. 50601 | hypothetical protein MGC10986 | SS | 4.9 |
| 421909 | NM_013375 | Hs. 109428 | TATA-binding protein-binding p | | 4.9 |
| 419667 | AU077005 | Hs. 92208 | a disintegrin and metalloprote | disintegrin, Reprolysin, Pe | 4.9 |
| 443496 | AJ006973 | Hs.9482 | target of myb1 (chicken) homol | VHS, GAT, TM, Heme_oxygenase | 4.9 |
| 400933 | | | NM_004347 *Homo sapiens* caspase | ICE_p20, ICE_p10, CARD, SS, l | 4.9 |
| 456143 | H11097 | Hs. 61960 | hypothetical protein | SS, pkinase | 4.9 |
| 427527 | AI809057 | Hs.153261 | immunoglobulin heavy constant | SS, TM, ig | 4.9 |
| 414265 | BE410411 | Hs.75864 | endoplasmic reticulum glycopro | | 4.9 |
| 433933 | AI754389 | | *Homo sapiens* clone TCCCIA00164 | SS, TM, SS, TM, SH2, Y_phospha | 4.9 |
| 452302 | AF173867 | Hs. 28906 | glucocorticoid modulatory elem | SAND, SS | 4.9 |
| 409938 | AW974648 | | gb: EST386752 MAGE resequences, | SS, Adap_comp_sub, GYF | 4.8 |
| 400845 | | | NM_003105*: *Homo sapiens* sortil | Idl_recept_a, fn3, Idl_rece | 4.8 |
| 425976 | C75094 | Hs. 334514 | NG22 protein | SS, TM, pkinase, SH2, SH3, BNR | 4.8 |
| 452969 | W92792 | Hs. 77575 | hypothetical protein MGC3136 | | 4.8 |
| 413163 | Y00815 | Hs. 75216 | protein tyrosine phosphatase, | fn3, ig, Y_phosphatase, SS, T | 4.8 |
| 434962 | AK001574 | Hs. 4291 | golgi peripheral membrane prot | | 4.8 |
| 418572 | AI751740 | Hs.86172 | paired related homeobox protein | homeobox | 4.8 |
| 440869 | NM_014297 | Hs. 7486 | protein expressed in thyroid | lactamase_B, SS, XRCC1_N, BR | 4.8 |
| 453446 | BE299996 | | gb: 600944574F1 NIH_MGC_17 Homo | | 4.8 |
| 412159 | AF286598 | Hs. 9271 | KIAA1071 protein | bZIP | 4.8 |
| 438999 | AW276811 | | gb xp66c02.x1 NCI_CGAP_Ov39 Ho | | 4.8 |
| 420233 | AA256714 | Hs. 194864 | hypothetical protein FLJ22578 | SS | 4.8 |
| 414576 | AK000405 | Hs. 76480 | ubiquitin-like 4 | ubiquitin, SS, TM, G6PD, G6PD | 4.8 |
| 433669 | AL047879 | Hs. 80475 | ESTs, Weakly similar to ALU2_H | SS, TM, RNA_pol_L, RasGAP, C2 | 4.8 |
| 448984 | AW751955 | Hs.22753 | hypothetical protein FLJ22318 | SS | 4.8 |
| 426912 | AL043054 | Hs. 256657 | ESTs, Weakly similar to A46302 | SS | 4.8 |
| 418945 | BE246762 | Hs. 89499 | arachidonate 5-lipoxygenase | lipoxygenase, PLAT, SS | 4.8 |
| 440333 | AI378424 | Hs. 288761 | hypothetical protein FLJ21749 | SS, TM, IP_trans, pkinase, pk | 4.8 |
| 425615 | AF023614 | Hs. 158341 | transmembrane activator and CA | TM | 4.8 |
| 458368 | BE280562 | Hs. 287711 | hypothetical protein FLJ22692 | | 4.8 |
| 458367 | AA088470 | Hs.83135 | *Homo sapiens*, Similar to RIKEN | SS, tRNA-synt_2d | 4.8 |
| 433294 | AA582082 | Hs.199410 | ESTs | | 4.8 |
| 437671 | AA536047 | Hs. 9850 | hypothetical protein MGC1842 | | 4.8 |
| 425338 | H16716 | Hs. 182648 | *Homo sapiens* cDNA FLJ14444 fis | | 4.8 |
| 447946 | AI566164 | Hs. 165827 | ESTs | SS, PTN_MK, 7tm_1, DAGKc, DAG | 4.7 |
| 447205 | BE617015 | Hs. 11006 | ESTs, Moderately similar to T1 | SS, TM, LRRCT, Sema | 4.7 |
| 416880 | H99640 | Hs.53687 | EST | | 4.7 |
| 440150 | AW975738 | Hs. 7001 | *Homo sapiens*, clone IMAGE.3940 | SS, TM, SS, TM, Peptidase_M22 | 4.7 |
| 426268 | AF083420 | Hs. 168913 | serine/threonine kinase 24 (St | pkinase, pkinase | 4.7 |
| 429253 | Y11739 | Hs. 198313 | winged-helix nude | Fork_head, SS, TM, glycolyti | 4.7 |
| 450261 | AA788727 | Hs. 34068 | ESTs, Weakly similar to A43932 | SS | 4.7 |
| 439246 | AI498072 | | membrane-associated tyrosine- | SS, SS, TM | 4.7 |
| 419120 | BE271922 | | ESTs, Weakly similar to zinc f | SS, TM, DENN, Cytidylyltrans | 4.7 |
| 416487 | AW190458 | Hs. 79347 | KIAA0211 gene product | SS, zf-C2H2 | 4.7 |
| 413837 | AW163525 | | titin-cap (telethonin) | SS, Methyltransf_3 | 4.7 |
| 419887 | AW292562 | Hs. 187628 | ESTs | TM | 4.7 |
| 410277 | R88621 | Hs. 26249 | ESTs, Weakly similar to T2D3_H | SS, TM, SS | 4.7 |
| 415169 | W42913 | Hs. 78089 | ATPase, vacuolar, 14 kD | ATP-synt_F, SS, TM, CH, Filam | 4.7 |
| 410892 | AW809762 | Hs. 222056 | *Homo sapiens* cDNA FLJ11572 fis | | 4.7 |
| 407754 | AA527348 | Hs. 288967 | *Homo sapiens* cDNA FLJ14105 fis | SS, TM, SS, TM, TSPN, tsp_3, SE | 4.7 |
| 409877 | AW502498 | Hs.15220 | zinc finger protein 106 | | 4.7 |
| 431629 | AU077025 | Hs. 265827 | interferon, alpha-inducible pr | pkinase, SH2, SH3 | 4.7 |
| 438800 | AB037108 | Hs. 6418 | seven transmembrane domain orp | SS, TM | 4.7 |
| 420823 | R96881 | Hs. 63609 | Hpall tiny fragments locus 9C | TM | 4.7 |
| 418900 | BE207357 | Hs.3454 | KIAA1821 protein | SS | 4.7 |
| 402400 | | | Target Exon | SS, TM, RNase_HII, bZIP, DUF2 | 4.7 |
| 419625 | U91616 | Hs. 91640 | nuclear factor of kappa light | ank, SS, TM | 4.7 |
| 433319 | AA583232 | | ESTs | SS | 4.7 |
| 424959 | NM_005781 | Hs.153937 | activated p21cdc42Hs. kinase | pkinase, SH3 | 4.7 |
| 432750 | NM_014440 | Hs.278910 | interleukin 1, epsilon | IL1 | 4.7 |
| 425954 | AK000633 | Hs.164476 | hypothetical protein FLJ20626 | SCAN, zf-C2H2, KRAB, SS, KRAB | 4.7 |
| 447245 | AK001713 | Hs. 17860 | hypothetical protein FLJ10851 | E1_dehydrog | 4.7 |
| 427101 | R87591 | Hs.172684 | ESTs | SS, TM | 4.6 |
| 447544 | AA401573 | Hs. 288284 | hypothetical protein FLJ22378 | SS, TM | 4.6 |
| 400266 | | | NM_002858*: *Homo sapiens* ATP-bi | ABC_tran | 4.6 |
| 412841 | AI751157 | Hs.101395 | hypothetical protein MGC11352 | SS, TM | 4.6 |
| 422066 | AW249275 | Hs.343521 | malate dehydrogenase 2, NAD (m | Idh, ldh_C, adh_short, Semia | 4.6 |
| 414874 | D26351 | Hs. 77515 | inositol 1,4,5-triphosphate re | TM, RYDR_ITPR, ion_trans, MI | 4.6 |
| 418373 | AW750770 | Hs. 84344 | CGI-135 protein | SS, TM, PMP22_Claudin, 2OG-F | 4.6 |
| 424487 | T08754 | Hs. 6259 | KIAA1698 protein | SS, SS, TM, Glyco_hydro_31, G | 4.6 |
| 426571 | AA381642 | | gb: EST94816 Activated T-cells | | 4.6 |
| 433941 | AA620612 | | ESTs | SS, TM, TNFR_c6 | 4.6 |

TABLE 17A-continued

| Pkey | ExAccn | UniGene ID | Unigene Title | Pred Protein Dom. | R1 |
|---|---|---|---|---|---|
| 421717 | AF230924 | Hs. 107187 | divalent cation tolerant prote | | 4.6 |
| 450883 | NM_001348 | Hs. 25619 | death-associated protein kinas | pkinase, GTP_EFTU, EFG_C, GT | 4.6 |
| 427361 | AW732480 | Hs. 7678 | cellular retinoic acid-binding | SS, TM, aminotran_1_2, LRR | 4.6 |
| 420421 | AF281133 | Hs. 343589 | exosome component Rrp41 | RNase_PH, RNase_PH_C | 4.6 |
| 414513 | AW239400 | Hs. 76297 | G protein-coupled receptor kin | pkinase, RGS, pkinase_C, SS, | 4.6 |
| 431498 | AK001777 | Hs. 258551 | aspartyl aminopeptidase | SS, Peptidase_M18, SS, TM, Y_ | 4.6 |
| 432593 | AW301003 | Hs.51483 | ESTs, Weakly similar to hypoth | SS, TM, adh_short | 4.6 |
| 404661 | | | C9000306* gi|12737280|ref|XP_0 | | 4.6 |
| 412790 | NM_014767 | Hs. 74583 | KIAA0275 gene product | kazal, thyroglobulin_1, zf- | 4.6 |
| 456243 | AI345001 | Hs.82380 | menage a trois 1 (CAK assembly | Zf-C3HC4 | 4.6 |
| 426222 | BE391706 | Hs.168073 | DKFZP727M231 protein | GSH_synthase | 4.6 |
| 439594 | AI245026 | Hs.111099 | hypothetical protein MGC10974 | CLP_protease | 4.6 |
| 409114 | AA070021 | | gb zm67h03 r1 Stratagene neuro | | 4.6 |
| 429049 | AW452125 | Hs.119273 | KIAA0296 gene product | SS, TM, trypsin | 4.6 |
| 424271 | AI991887 | Hs. 305882 | 5-oxoprolinase (ATP-hydrolysin | | 4.6 |
| 418741 | H83265 | Hs. 8881 | ESTs, Weakly similar to S41044 | SS, TM, pkinase, Activin_rec | 4.6 |
| 450493 | M93718 | Hs. 166373 | nitric oxide synthase 3 (endot | flavodoxin, FAD_binding, NO | 4.6 |
| 433074 | AL045019 | Hs. 323462 | Homo sapiens cDNA FLJ11214 fis | DEAD, helicase_C, dsrm, Vira | 4.6 |
| 444893 | AW249312 | Hs.12109 | WD40 protein Ciao1 | WD40 | 4.6 |
| 420508 | AJ270993 | Hs. 98428 | homeo box B6 | homeobox, SS, homeobox, home | 4.6 |
| 409591 | AA532963 | Hs. 9100 | Homo sapiens cDNA FLJ13100 fis | SS, TM, LIM, homeobox | 4.6 |
| 456181 | L36463 | Hs. 1030 | ras inhibitor | RA, SH2, VPS9, SS, TM, Nucleos | 4.6 |
| 439270 | BE268278 | Hs. 28393 | hypothetical protein MGC2592 | SS, TM, HCO3_cotransp | 4.6 |
| 440104 | AA132838 | Hs. 239894 | hypothetical protein MGC2803 | SS, DS | 4.5 |
| 423279 | AW959861 | Hs. 290943 | ESTs | SS | 4.5 |
| 445087 | AW893449 | Hs.12303 | suppressor of Ty (S.cerevisiae | S1, SH2, Ribosomal_L23, pkin | 4.5 |
| 404036 | | | Target Exon | SS, TM, cadherin, cadherin | 4.5 |
| 431832 | AW276866 | Hs. 192715 | ESTs | Ets, SAM_PNT | 4.5 |
| 433886 | AA613596 | Hs. 28412 | ESTs | SS | 4.5 |
| 426735 | T78716 | Hs. 120446 | ESTs | Oxysterol_BP, PH | 4.5 |
| 417825 | AW838994 | Hs. 6363 | heparan sulfate 6-O-sulfotrans | SS, TM | 4.5 |
| 455600 | BE061053 | | gb: QV0-BT0041-271099-037-d09 B | C4 | 4.5 |
| 423858 | AL137326 | Hs. 133483 | Homo sapiens mRNA, cDNA DKFZp4 | SS, TM | 4.5 |
| 421680 | AL031186 | Hs. 289106 | Human DNA sequence from clone | SS, SS, rrm, zf-RanBP, rrm, GA | 4.5 |
| 408157 | AA047685 | Hs. 62946 | ESTs | pkinase | 4.5 |
| 434303 | AW204058 | | transforming growth factor bet | SS, TM, SSF, FG-GAP, vwa, inte | 4.5 |
| 440745 | AW303627 | Hs. 143301 | ESTs | | 4.5 |
| 419344 | U94905 | Hs.277445 | diacylglycerol kinase, zeta (1 | ank, DAGKa, DAGKc, DAG_PE-bi | 4.5 |
| 447208 | BE315291 | Hs.237971 | hypothetical protein MGC5627 | | 4.5 |
| 436163 | R84938 | | gb yt65f04.r1 Soares retina N2 | | 4.5 |
| 456856 | AK001528 | Hs. 347285 | Homo sapiens, Similar to DiGeo | | 4.5 |
| 410817 | AI262789 | Hs. 93659 | protein disulfide isomerase re | SS, thiored | 4.5 |
| 434558 | AW264102 | Hs.39168 | ESTs | SS, TM, LRRCT, LRR | 4.5 |
| 440548 | AL117408 | Hs.7274 | DKFZP434P1750 protein | | 4.5 |
| 450200 | AW975625 | Hs.173088 | ESTs | Zf-UBP, zf-C3HC4 | 4.5 |
| 432434 | AL161977 | Hs. 2994 | PCTAIRE protein kinase 3 | SS, pkinase | 4.5 |
| 440042 | AI073387 | Hs. 133898 | ESTs | SS | 4.5 |
| 454328 | AW372097 | Hs. 278429 | hepatocellular carcinoma-assoc | | 4.5 |
| 458196 | AI802408 | | ubiquitin A-52 residue ribosom | SS, TM, fn3, FKBP, TPR | 4.5 |
| 433472 | AI541246 | Hs. 3343 | phosphoglycerate dehydrogenase | 2-Hacid_DH, 2-Hacid_DH_C, M | 4.5 |
| 408928 | AW295827 | Hs. 255479 | hypothetical protein MGC5566 | A_deaminase, A_deaminase | 4.5 |
| 448093 | AW977382 | Hs.15898 | 2,4-dienoyl CoA reductase 2, p | adh_short, NDK | 4.5 |
| 426272 | AW450671 | Hs. 189284 | ESTs | | 4.5 |
| 453610 | AW368882 | Hs. 33818 | RecQ protein-like 5 | SS, DEAD, helicase_C, SS, DEA | 4.5 |
| 441327 | AK001706 | Hs.7778 | hypothetical protein FLJ10751 | SS, TM, 7tm_1 | 4.5 |
| 424681 | AA054400 | Hs. 151706 | KIAA0134 gene product | helicase_C, PRK, SS, TM, 7tm_ | 4.5 |
| 443443 | AI344042 | Hs. 9347 | regulator of G-protein signall | TM, Na_Pi_cotrans | 4.5 |
| 426677 | AW949856 | Hs. 97165 | ESTs | SS | 4.5 |
| 412482 | AI499930 | Hs.334885 | mitochondrial GTP binding prot | SS | 4.4 |
| 425236 | AW067800 | Hs.155223 | stanniocalcin 2 | Stanniocalcin, SS | 4.4 |
| 423229 | AC003965 | Hs.125532 | protease, serine, 26 | trypsin, SS | 4.4 |
| 412338 | AA151527 | Hs. 69485 | hypothetical protein FLJ12436 | SS, TM, TIG, Serina, PSI | 4.4 |
| 419395 | BE268326 | Hs. 90280 | 5-aminoimidazole-4-carboxamide | AICARFT_IMPCHas, MGS, AICAR | 4.4 |
| 442462 | AF031405 | | gb AF031405 Soares fetal liver | | 4.4 |
| 439975 | AW328081 | Hs. 6817 | inosine triphosphatase (nucleo | Ham1p_like, SS | 4.4 |
| 423876 | BE502835 | Hs.15463 | Homo sapiens, clone IMAGE 2959 | SS, ethanol | 4.4 |
| 423220 | BE394920 | Hs.125262 | aladin | WD40, TM, Activin_recp, pkin | 4.4 |
| 411574 | BE242842 | Hs. 6780 | protein tyrosine kinase 9-like | cofilin_ADF, SS, TM | 4.4 |
| 448947 | BE615408 | Hs. 337228 | ESTs, Weakly similar to AXHU a | SS, TM, ig, pkinase | 4.4 |
| 407755 | AI151353 | Hs.29742 | Homo sapiens serine palmitoyl | SS, TM, aminotran_1_2 | 4.4 |
| 414849 | AW372721 | Hs.291623 | ESTs, Weakly similar to unname | TM, pkinase | 4.4 |
| 458171 | AI420016 | Hs.192090 | ESTs | SS, TM | 4.4 |
| 424443 | AI751281 | Hs. 284161 | hypothetical protein from EURO | SS, TM, SS, TM | 4.4 |
| 427002 | AA524093 | Hs. 23158 | ESTs | SS, zf-C2H2 | 4.4 |
| 404344 | | | C7002191* gi|5053028|gb|AAD388 | SS, ABC_tran | 4.4 |
| 427458 | BE208364 | Hs. 29283 | ESTs, Weakly similar to LKHU p | SS, F5_F8_type_C, EGF, TGT | 4.4 |
| 419764 | BE262524 | Hs.93183 | vasodilator-stimulated phospho | WH1 | 4.4 |

TABLE 17A-continued

| Pkey | ExAccn | UniGene ID | Unigene Title | Pred Protein Dom. | R1 |
|---|---|---|---|---|---|
| 446872 | X97058 | Hs. 16362 | pyrimidinergic receptor P2Y, G | 7tm_1, SS, TM | 4.4 |
| 435615 | Y15065 | Hs. 4975 | potassium voltage-gated channe | ion_trans, KCNQ1_channel | 4.4 |
| 403945 | | | Target Exon | | 4.3 |
| 435593 | R88872 | Hs.4964 | DKFZP586J1624 protein | Herpes_HEPA, SS | 4.3 |
| 421899 | AJ011895 | Hs.109281 | Nef-associated factor 1 | Virus_HS, bZIP, G-gamma, Myo | 4.3 |
| 425245 | AI751768 | Hs. 155314 | KIAA0095 gene product | SS, TM | 4.3 |
| 423348 | AA324687 | | gb EST27558 Cerebellum Il Homo | SS, TM | 4.3 |
| 452105 | AA022838 | Hs.6570 | ESTs, Weakly similar to S10889 | SS, TM, TBC, rrm | 4.3 |
| 431934 | AB031481 | Hs. 272214 | STG protein | SS | 4.3 |
| 429499 | AA453809 | Hs. 99350 | ESTs | | 4.3 |
| 453485 | BE620712 | Hs. 33026 | hypothetical protein PP2447 | SS, TM | 4.3 |
| 459393 | BE409283 | Hs. 193264 | hypothetical protein MGC3234 | | 4.3 |
| 405364 | | | ENSP00000239138* Guanine nucle | | 4.3 |
| 428345 | AI242431 | Hs. 118282 | PAP-1 binding protein | SS, TM | 4.3 |
| 435327 | BE301871 | Hs. 4867 | mannosyl (alpha-1,3-)-glycopro | SS, HLH, Myc_N_term, Myc-LZ, | 4.3 |
| 413053 | AW963263 | Hs. 65377 | ESTs, Moderately similar to KI | TM, SS, TM, EF_TS, UBA, transm | 4.3 |
| 409983 | D50922 | Hs. 57729 | Kelch-like ECH-associated prot | BTB, Kelch, SS, TM | 4.3 |
| 409936 | AK001691 | Hs. 57655 | hypothetical protein FLJ10829 | SS, TM | 4.3 |
| 421592 | AF009801 | Hs. 105941 | bagpipe homeobox (Drosophila) | homeobox, SS | 4.3 |
| 424251 | AA677466 | Hs. 143696 | coactivator-associated arginin | SS, SNF2_N, helicase_C, brom | 4.3 |
| 414788 | X78342 | Hs.77313 | cyclin-dependent kinase (CDC2- | pkinase | 4.3 |
| 432805 | X94630 | Hs. 3107 | CD97 antigen | SS, TM, 7tm_2, GPS, EGF, SS, TM | 4.3 |
| 424927 | AW973666 | Hs.153850 | hypothetical protein C321D2 4 | SS, TM | 4.3 |
| 456863 | T16837 | Hs. 4241 | ESTs | fusion_gly, homeobox, TM | 4.3 |
| 417823 | R88869 | Hs.102447 | TSC-22-like | PWWP | 4.3 |
| 406621 | X57809 | Hs. 181125 | immunoglobulin lambda locus | SS | 4.3 |
| 431493 | AI791493 | Hs.129493 | ESTs, novel cytochrome P450 | SS, p450, SS | 4.3 |
| 412958 | BE391579 | Hs. 75087 | Fas-activated serine/threonine | SS, pkinase | 4.3 |
| 431658 | BE409917 | Hs. 266935 | tRNA selenocysteine associated | rrm, SS, RCC1 | 4.3 |
| 419579 | W49529 | Hs. 296200 | hypothetical protein AF053356_ | MSP_domain, SS, TM, CUB, NTR, | 4.3 |
| 410076 | T05387 | Hs.7991 | ESTs | SS | 4.2 |
| 406773 | AA812424 | Hs. 76067 | heat shock 27 kD protein 1 | HSP20, SS | 4.2 |
| 424709 | AL137589 | Hs. 152149 | hypothetical protein DKFZp434K | | 4.2 |
| 418419 | X55039 | Hs. 85004 | centromere protein B (80 kD) | CENP-B, HTH_5 | 4.2 |
| 447377 | X77343 | Hs. 334334 | transcription factor AP-2 alph | TF_AP-2, TF_AP-2 | 4.2 |
| 416931 | D45371 | Hs. 80485 | adipose most abundant gene tra | C1q, Collagen, SS | 4.2 |
| 411674 | AW861123 | | gb.RC3-CT0297-120200-014-a05 C | SS | 4.2 |
| 419073 | AW372170 | Hs. 183918 | *Homo sapiens* cDNA FLJ12797 fis | SS, ig, tsp_1, ZU5, SS, TM, Nuc | 4.2 |
| 406867 | AA157857 | Hs. 182265 | keratin 19 | filament, bZIP, SS, filament | 4.2 |
| 432183 | AW151952 | Hs.46679 | hypothetical protein FLJ20739 | SS | 4.2 |
| 418910 | Z25821 | Hs. 89466 | *Homo sapiens*, Similar to dodec | ECH, SS, TM, aminotran_3, ABC | 4.2 |
| 437300 | AL040504 | Hs. 25063 | PRO0461 protein | SS, TM, pkinase, cyclin, F-bo | 4.2 |
| 426615 | AA400678 | Hs. 6473 | gb zu70a11 r1 Soares_testis_NH | | 4.2 |
| 421453 | AA234652 | Hs. 104555 | neuropeptide FF-amide peptide | SS, bZIP, zf-C2H2, bZIP, zf-C | 4.2 |
| 409616 | AA076248 | | gb zm18c10 r1 Stratagene pancr | | 4.2 |
| 444744 | BE394732 | Hs.147562 | ESTs | SS | 4.2 |
| 412575 | AA113177 | | gb zm29e05.s1 Stratagene pancr | TM, ER_lumen_recept | 4.2 |
| 429542 | AF038660 | Hs. 206713 | UDP-Gal betaGlcNAc beta 1,4-g | Galactosyl_T_2, ig, SS, TM, A | 4.2 |
| 435995 | BE260415 | Hs. 348198 | hypothetical protein FLJ20262 | | 4.2 |
| 451585 | AK001171 | Hs. 326422 | hypothetical protein MGC4549 | SS, Metallophos | 4.2 |
| 456153 | AW972270 | Hs.144054 | ESTs | SS, TM | 4.2 |
| 455340 | AW901435 | | gb: RC0-NN1012-270300-031-a10 N | | 4.2 |
| 457268 | AW272279 | | ESTs, Moderately similar to AL | | 4.2 |
| 432311 | BE083080 | Hs.274323 | similar to sialyltransferase 7 | Glyco_transf_29 | 4.2 |
| 409656 | NM_005133 | Hs. 288626 | RCE1, prenyl protein protease | Abi, SS, CPSase_L_chain, HMG | 4.2 |
| 424919 | BE314461 | Hs. 153768 | U3 snoRNP-associated 55-kDa pr | WD40, SS, KH-domain | 4.2 |
| 416528 | H65052 | Hs. 337621 | ESTs | | 4.2 |
| 415137 | AI634834 | Hs.72451 | *Homo sapiens* PAC clone RP5-108 | | 4.2 |
| 417334 | AA337572 | Hs. 157240 | hypothetical protein MGC4737 | SS, TM, ion_trans | 4.2 |
| 451920 | AA224483 | Hs. 27239 | DKFZP586K0524 protein | SS, TM, SS, TM | 4.2 |
| 413049 | NM_002151 | Hs. 823 | hepsin (transmembrane protease | trypsin, SS, TM, ATP1G1_PLM_ | 4.2 |
| 458988 | AW410431 | Hs. 283670 | CGI-119 protein | | 4.2 |
| 406964 | M21305 | | FGENES predicted novel secrete | | 4.2 |
| 451595 | AW965569 | Hs. 20996 | ESTs | SS, WD40 | 4.2 |
| 449728 | AI820751 | Hs. 107635 | ESTs | SS | 4.1 |
| 453245 | T99801 | Hs. 339751 | ESTs | TM, ABC_tran | 4.1 |
| 432238 | AL133057 | Hs.274135 | *Homo sapiens* mRNA; cDNA DKFZp4 | WD40, LRR | 4.1 |
| 430037 | BE409649 | Hs. 227789 | mitogen-activated protein kina | pkinase | 4.1 |
| 442196 | AI902646 | Hs. 31844 | hypothetical protein FLJ12586 | SS, SCAN | 4.1 |
| 425251 | Z22521 | Hs. 155342 | protein kinase C, delta | pkinase, DAG_PE-bind, pkina | 4.1 |
| 415014 | AW954064 | Hs.24951 | ESTs | | 4.1 |
| 440088 | BE559877 | Hs. 183232 | hypothetical protein FLJ22638 | SS, zf-C3HC4, SPRY, zf-B_box | 4.1 |
| 418837 | U48263 | Hs. 89040 | preproorociceptin | Opiods_neuropep, SS | 4.1 |
| 410239 | AI568350 | Hs. 61273 | hypothetical protein MGC2650 | SS, ART, TM | 4.1 |
| 446975 | BE246446 | Hs.16695 | ubiquitin-activating enzyme E1 | ThiF, UBACT | 4.1 |
| 453968 | AA847843 | Hs.62711 | High mobility group (nonhiston | SS, HMG_box | 4.1 |
| 448241 | AW811064 | | gb.MR2-ST0131-211099-008-c06 S | SS | 4.1 |

TABLE 17A-continued

| Pkey | ExAccn | UniGene ID | Unigene Title | Pred Protein Dom. | R1 |
|---|---|---|---|---|---|
| 441455 | AJ271671 | Hs.7854 | zinc/iron regulated transporte | Zip, SS, TM, Cytidylyltransf | 4.1 |
| 450848 | AI677994 | Hs. 428 | fms-related tyrosine kinase 3 | fit3_lig, SS, Ribosomal_L13 | 4.1 |
| 429218 | AA225065 | Hs.198269 | Target CAT | SS, Nop | 4.1 |
| 425437 | AK000482 | Hs.181780 | hypothetical protein FLJ20241 | | 4.1 |
| 406613 | | | Target Exon | SS, pkinase, LRR, LRRCT, Ribo | 4.1 |
| 431239 | AL039971 | Hs.251216 | hypothetical protein DKFZp434A | ank, WH2 | 4.1 |
| 436057 | AJ004832 | Hs.5038 | neuropathy target esterase | cNMP_binding, SS, TM, cNMP_b | 4.1 |
| 415193 | AL048891 | Hs.12185 | hypothetical protein MGC14333 | SS, TM, aminotran_1_2, LRR | 4.1 |
| 424619 | BE387282 | Hs.207443 | hypothetical protein MGC10848 | | 4.1 |
| 432968 | BE614192 | Hs. 279869 | melanoma-associated antigen re | SS, TM, RGS, DIX | 4.1 |
| 428156 | BE269388 | Hs. 182698 | mitochondrial ribosomal protei | SS | 4.1 |
| 414084 | AW168771 | Hs.71574 | hypothetical protein FLJ14926 | SS, P5CR, EFIBD | 4.1 |
| 424964 | AW161271 | Hs. 153961 | ARP1 (actin-related protein 1, | actin, SS | 4.1 |
| 431410 | AW299534 | Hs.105739 | ESTs | | 4.1 |
| 435968 | AW161481 | Hs.111577 | integral membrane protein 3 | TM | 4.1 |
| 432351 | AI270313 | Hs. 127762 | hypothetical protein MGC12982 | | 4.1 |
| 426120 | AA325243 | Hs.166887 | copine I | C2, SS, aminotran_5 | 4.1 |
| 416877 | BE386266 | Hs.85658 | hypothetical protein FLJ23436 | | 4.1 |
| 425970 | AK001500 | Hs. 165186 | hypothetical protein FLJ13852 | SS, P5CR, Epimerase, zf-C2H2 | 4.1 |
| 434848 | BE256304 | Hs.32148 | AD-015 protein | SS, TM, SS, TM, LRR, P, Peptida | 4.1 |
| 458715 | AK000973 | Hs. 16725 | hypothetical protein FLJ10111 | IBR, zt-C3HC4, SS, TM, IRF, CK | 4.1 |
| 435851 | AA700946 | | ESTs | | 4.1 |
| 425538 | BE270918 | Hs.164026 | Homo sapiens, clone IMAGE: 3534 | SS, SNF2_N, helicase_C, brom | 4.1 |
| 444416 | AW288085 | Hs. 11156 | hypothetical protein | zf-C3HC4, SpoA, PHD, TM, syna | 4.0 |
| 426831 | BE296216 | Hs.172673 | S-adenosylhomocysteine hydrola | AdoHcyase, SS | 4.0 |
| 444596 | BE560662 | Hs. 11417 | Rab acceptor 1 (prenylated) | SS, TM, lig_chan, ANF_recept | 4.0 |
| 439685 | AW956781 | Hs. 293937 | ESTs, Weakly similar to FXD2_H | SS, PWWP, TSC22 | 4.0 |
| 447402 | H54520 | Hs.18490 | hypothetical protein FLJ20452 | SS, TM | 4.0 |
| 450184 | W31096 | Hs.237617 | Homo sapiens, clone IMAGE: 3447 | SS | 4.0 |
| 426068 | AF029778 | Hs.166154 | jagged 2 | DSL, EGF, vwc, granulin, SS, T | 4.0 |
| 459255 | AI93244 | Hs. 239500 | hypothetical protein MGC13114 | SS | 4.0 |
| 403182 | | | Target Exon | | 4.0 |
| 432078 | BE314877 | Hs. 24553 | hypothetical protein FLJ12541 | SS, TM | 4.0 |
| 459167 | BE504370 | | ESTs, Weakly similar to CA13_H | SS | 4.0 |
| 452747 | BE153855 | Hs.61460 | Ig superfamily receptor LNIR | SS, TM, ig, HLH | 4.0 |
| 444633 | AF111713 | Hs.286218 | junctional adhesion molecule 1 | ig, SS, TM, HLH | 4.0 |
| 434171 | BE247688 | Hs.347349 | KIAA0948 protein | | 4.0 |
| 422155 | AW249152 | | sirtuin (silent mating type in | SIR2, HLH, Myc_N_term, Myc-L | 4.0 |
| 433262 | AI571225 | Hs.284171 | KIAA1535 protein | SS, TM, cNMP_binding, ion_tr | 4.0 |
| 442599 | AF078037 | Hs.324051 | RelA-associated inhibitor | SH3, ank, SS, TM, HHH, ig | 4.0 |
| 452500 | AW373011 | Hs.54558 | hypothetical protein FLJ22222 | | 4.0 |
| 437563 | AI217204 | Hs. 144968 | ESTs | | 4.0 |
| 432234 | AA531128 | Hs. 115803 | ESTs | SS | 4.0 |
| 433135 | AA443873 | Hs. 110477 | dolichyl-phosphate mannosyltra | | 4.0 |
| 447495 | AW401864 | Hs. 18720 | programmed cell death 8 (apopt | pyr_redox, SS, Ets | 4.0 |
| 452857 | BE072814 | Hs.258519 | ESTs, Moderately similar to S6 | SS | 4.0 |
| 427834 | AA506101 | Hs. 285813 | hypothetical protein FLJ11807 | SS, TM | 4.0 |
| 418963 | BE304571 | Hs. 89529 | aldo-keto reductase family 1, | aldo_ket_red | 4.0 |
| 437340 | AL353935 | Hs.135917 | hypothetical protein DKFZp761D | TBC, bZIP, WD40, WD40 | 4.0 |
| 455928 | BE170313 | | gb QV4-HT0536-040500-193-g02 H | SS | 4.0 |
| 400607 | | | Target Exon | SS, homeobox | 4.0 |
| 424825 | AF207069 | Hs. 153357 | procollagen-lysine, 2-oxogluta | 2OG-FeII_Oxy, Glycos_trans | 4.0 |
| 438143 | BE500981 | Hs. 269652 | ESTs | | 4.0 |
| 433173 | Z35093 | Hs.3196 | surfeit 1 | SURF1, SS, TM, SURF1, SURF4 | 4.0 |
| 412550 | R52452 | Hs. 26370 | gb yg80g07.r1 Soares infant br | | 4.0 |

Pkey: Unique Eos probeset identifier number
ExAccn: Exemplar Accession number, Genbank accession number
UnigeneID: Unigene number
Unigene Title: Unigene gene title
Pred. Protein Dom.: Predicted protein domain
R1: Ratio of tumor to normal ovaries

TABLE 17B

| Pkey | CAT Number | Accession |
|---|---|---|
| 408215 | 10478_1 | BE614290 AA307674 N35629 AA338538 AI193603 AA781096 AI680061 AI613258 AW276647 BE221263 AI348910 AI985031 AI090078 AI359617 AA666391 AI160210 AI446461 AI355345 AI343638 AI343640 AI275091 M78746 AW262795 AW250002 AA503756 AI934519 AW272086 N26520 AA626639 |
| 408294 | 1050553_1 | BE141732 U75823 BE141331 AW178416 AW178430 BE141343 BE141298 BE141702 BE141285 |

TABLE 17B-continued

| Pkey | CAT Number | Accession |
|---|---|---|
| 409114 | 110088_1 | AA070021 AA126205 AA082771 AA102169 AA083530 AA082183 AA115915 AA085147 AA125905 AA063336 AA079206 |
| 409164 | 110421_1 | AA706639 AA064707 AL036920 AI651598 |
| 409616 | 114348_1 | AA076248 AA120958 AA122152 AA076249 |
| 409938 | 116091_1 | AW974648 AA652153 AA649671 AA078582 |
| 409960 | 116270_1 | BE261944 AA715461 AA318136 AA134972 AA319849 W04622 AI291655 AW879092 AA130778 BE314003 AA908246 AW960808 AA385346 AA205977 C02043 AA135057 AA078870 AA377395 AA318795 AA318785 AA319160 BE000960 AW370250 AW370244 T85930 AA759250 AI567682 AA932839 AI056920 |
| 410445 | 120374_2 | AA199830 AI143895 AW961629 AA322482 |
| 411219 | 1236055_1 | AW832917 AW832913 AW832906 AW832788 AW832915 AW832776 |
| 411674 | 1253746_1 | AW861123 AW861125 AW856717 AW861116 AW856706 AW856788 AW856774 AW856787 AW856780 AW856782 AW856789 AW856772 AW856784 AW856786 AW856776 AW856635 AW856767 |
| 412091 | 1276564_1 | R06185 AW891805 AW901892 AW901895 |
| 412173 | 1280870_1 | T71071 AW902279 AW897608 |
| 412575 | 130769_1 | AA113177 AW894515 AA113847 |
| 413534 | 1375357_1 | BE146961 BE146780 BE146788 BE146967 BE146774 BE146963 BE146907 |
| 413564 | 1376722_1 | BE260120 BE148538 |
| 413764 | 1387163_1 | BE162704 BE162705 BE162732 BE162702 BE162694 |
| 413837 | 139363_1 | AW163525 AW163255 AW163385 AI929359 BE279279 AA132590 AW157329 AA584408 AW157252 AI692198 AW003514 T24436 AI765658 AW157459 AI810740 AI659582 AI969924 AI929284 AI340993 AI349083 AW299522 AW664650 AW299513 AA132529 AI340991 AI912836 AI341293 AI650609 AA279 |
| 414413 | 1443696_1 | BE294877 BE294759 |
| 415126 | 1523506_1 | D60945 D61346 D81568 D80539 |
| 419120 | 182026_1 | BE271922 N54771 AA234233 AA471354 BE171081 AA253482 AA470113 AA824327 H24470 AW504757 N51688 AI400700 AA578548 AA714130 AA609917 AW780349 AW664465 AW467553 AW571643 AA469943 AW474826 AA767165 AA326817 AA593859 AW952245 AW341739 AA805093 AA779455 AW016655 |
| 422155 | 21235_1 | AW249152 AW249153 BE298958 AW192872 AF095714 R05553 AF083107 AF160214 NM_012237 BE258447 BE253088 AA297721 H68948 W39153 AA070372 H14246 AL079367 R24561 AW403997 AA297034 AA297092 F11858 AI372597 AA297787 Z42780 AA297072 T81280 T83544 AA297053 H26063 AA26 |
| 423348 | 227276_1 | AA324687 AA325155 AW962038 |
| 425858 | 257265_1 | AA364923 AW963483 BE182774 C21461 |
| 426571 | 269283_1 | AA381642 AA381664 AW963560 AW949848 AA381728 AA381608 |
| 427326 | 277229_1 | AI287878 AI804160 AA400787 |
| 428092 | 286920_1 | AW879141 AA421182 AI734104 AI733923 AA430600 |
| 429720 | 308153_1 | M79091 AA773950 AA586573 AA457225 |
| 430168 | 313927_1 | AW968343 AA468507 AI478223 AW513008 AI762122 AI554512 AA862642 AA468976 |
| 431424 | 333110_1 | AI222969 AA806560 AA504839 AA805261 |
| 433319 | 363095_1 | AA583232 AA601715 |
| 433933 | 377703_1 | AI754389 AW295190 AI056058 AI056059 AI863364 AI863355 AW131720 AI674922 AI949042 AI990060 AI623178 AW469497 AA620354 |
| 433941 | 377883_1 | AA620612 AA994983 AA994990 |
| 434303 | 383224_1 | AW204058 AI424379 AI669663 AA629077 AW613033 |
| 434743 | 3925_1 | AI363410 AI356019 H00141 T78748 AL049365 AL079911 AI750972 Z42602 AW452523 AI223826 AA215407 AI633829 AA292122 N42783 AW505595 AF086096 N90340 N63271 AA131836 AW607273 AA527132 T32315 AA421961 T34951 AW966080 M78807 N31947 AA521151 AA278866 AA044784 AA700 |
| 434796 | 393400_1 | AA812046 AW974514 AA764999 AA649302 |
| 435851 | 411522_1 | AA700946 AA702712 AA947620 |
| 436163 | 41515_6 | R84938 AL047151 AA310309 AW063200 AI569528 AI307823 N49975 |
| 437215 | 43473_1 | AL117488 AL044479 |
| 438999 | 467686_1 | AW276811 AA829050 AA829190 |
| 439246 | 47021_3 | AI498072 AW251083 AA985226 AA852987 AI392809 AA206609 AW190187 AA555262 AF086057 F35814 AW516382 AA377885 N50847 F27148 AA731186 AA417728 AI003145 |
| 440317 | 49187_1 | BE561888 BE560615 BE562102 |
| 442462 | 543232_1 | AF031405 H73415 |
| 442472 | 543371_1 | AW806859 AW806852 AF049582 |
| 445625 | 64558_1 | BE246743 AA436942 AW024744 AW242177 AA975476 AW385185 R07536 R73462 AV654529 T57442 AI399986 R50073 R48743 AI769689 AI863005 AA317806 AI678000 AW189963 AI986207 AW471273 R73463 AI335104 AI590161 AI469257 AI954604 H21954 T25141 AA856793 R50074 AI708253 AI2 |

TABLE 17B-continued

| Pkey | CAT Number | Accession |
|---|---|---|
| 445631 | 6457_1 | AK001822 AW860325 AA335296 AW965531 AW130957 AW193951 AI347975 AW081323 AW662527 AI343924 AI380749 AA938153 T66966 AI655000 AW418837 AI380485 AA410698 AI520726 BE501355 AI637925 AW779200 AI524755 AW593995 AI336927 AI336928 AI357036 R60592 H19058 R11124 T1 |
| 447128 | 70934_1 | AI271898 BE048502 AI452509 AI244810 X84721 AI858001 AI553937 AA149853 H00719 AI765259 AW973696 F25787 F35749 AI568815 AW015380 AA554539 C00201 AA961610 AW059537 R77127 |
| 448241 | 756181_1 | AW811064 AW811160 AI478413 |
| 448993 | 79225_1 | AI471630 BE540637 BE265481 AW407710 BE513882 BE546739 AA053597 BE140503 BE218514 AW956702 AI656234 AI636283 AI567265 AW340858 BE207794 AA053085 R69173 AA292343 AA454908 AA293504 AI659741 AI927478 AA399460 AI760441 AA346416 BE047245 AA730380 AA394063 AA454 |
| 453446 | 967533_1 | BE299996 BE297115 BE270415 BE295214 BE296526 |
| 454682 | 1228976_1 | AW816029 AW813292 AW816156 AW813333 AW816159 AW813302 AW813344 AW813172 |
| 455035 | 1249762_1 | AW851734 AW851676 AW851693 AW851713 AW851722 AW851616 AW851731 AW851618 AW851648 AW852215 |
| 455340 | 1283604_1 | AW901435 BE094527 |
| 455557 | 1325974_1 | AW995839 AW995907 |
| 455600 | 1335877_1 | BE061053 BE008959 BE008957 BE091618 |
| 455885 | 1380385_1 | BE153524 BE153576 BE153583 |
| 455928 | 1383899_1 | BE170313 BE158339 BE158290 |
| 456573 | 201205_1 | AI279811 AI301071 AI214696 AI279813 AA588460 AA287256 BE171665 |
| 457268 | 310453_1 | AW272279 AA461542 AA460615 |
| 457978 | 448900_1 | AA776638 BE439540 |
| 458196 | 503719_1 | AI802408 AA907424 AI279233 AI302762 N33153 BE045678 AI863332 AW173558 AI302328 Z20793 D25594 BE326823 |
| 459167 | 92053_1 | BE504370 AI243453 AI809556 AI702878 AI702163 AI300626 AW072219 AI369492 AI349587 AW779061 W78149 AA055693 AA974162 AI394380 AI830098 AW054857 AI870008 AW207658 AW665508 AW300595 AI192992 AW628019 AI274365 AA906922 N92547 AW054727 AW206667 AW136707 AW13761 |
| 459271 | 969257_1 | AL045934 AL039532 H55631 |

Pkey Unique Eos probeset identifier number
CAT number Gene cluster number
Accession Genbank accession numbers

TABLE 17C

| Pkey | Ref | Strand | Nt_position |
|---|---|---|---|
| 400460 | 8389428 | Plus | 35559–36295 |
| 400607 | 9887666 | Plus | 3112–4159 |
| 400833 | 8705148 | Minus | 187599–188138 |
| 400845 | 9188605 | Plus | 34428–34612 |
| 400923 | 7637836 | Minus | 94518–94659 |
| 400933 | 7651935 | Minus | 105330–105503 |
| 401210 | 7712287 | Plus | 166969–167133, 169760–169877, 171563–171733 |
| 401264 | 9797154 | Plus | 130810–130927, 133367–133504 |
| 401278 | 9799936 | Plus | 98428–98573 |
| 401609 | 7705041 | Minus | 9877–11997 |
| 401674 | 7689903 | Plus | 138786–138927, 139157–139298, 139440–139599, 139960–140159 |
| 401724 | 7656694 | Plus | 150063–150241 |
| 402197 | 8576113 | Plus | 199466–199585 |
| 402365 | 9454515 | Minus | 70928–71185 |
| 402393 | 9929688 | Plus | 19813–20084, 20163–20263 |
| 402400 | 9945145 | Minus | 80123–80322 |
| 402632 | 9931268 | Plus | 101166–101419 |
| 402884 | 9926562 | Plus | 47980–48191 |
| 402916 | 7406502 | Minus | 361–474, 541–687 |
| 403055 | 8748904 | Minus | 109532–110225 |
| 403128 | 7331426 | Plus | 122884–123018, 123134–123283, 123372–123695, 123779–123940, 124059–124256 |
| 403182 | 9838273 | Plus | 102163–102345, 102545–102725 |
| 403938 | 7711795 | Plus | 48636–48822 |
| 403945 | 7711869 | Minus | 32141–32263 |
| 404036 | 8567760 | Minus | 65247–67529, 112537–114863 |
| 404333 | 9802821 | Minus | 137948–138024, 138111–138300 |
| 404343 | 9838093 | Plus | 122664–122931 |
| 404344 | 9838093 | Plus | 127865–128384 |

TABLE 17C-continued

| Pkey | Ref | Strand | Nt_position |
|---|---|---|---|
| 404365 | 9964977 | Plus | 50151–50319, 50859–51098 |
| 404661 | 9797073 | Plus | 33374–33675, 33769–34008 |
| 404757 | 7706327 | Plus | 100933–101083, 101580–101782 |
| 404807 | 4165210 | Minus | 124246–124422 |
| 405334 | 3135285 | Plus | 139386–139856 |
| 405346 | 2981263 | Plus | 101982–102171 |
| 405364 | 2281075 | Minus | 48325–48491, 49136–49252 |
| 405371 | 2078469 | Minus | 47657–47766, 48461–48596 |
| 405594 | 6960456 | Plus | 161628–161734, 162823–163014, 164439–164652 |
| 405928 | 7717155 | Minus | 2923–3209 |
| 406230 | 4760409 | Plus | 71716–72515 |
| 406244 | 7417725 | Plus | 39422–39595 |
| 406301 | 8575868 | Plus | 57291–57494 |
| 406487 | 7711306 | Plus | 82039–82902 |
| 406495 | 7711328 | Minus | 174661–174978 |
| 406613 | 2957168 | Plus | 5029–5147 |

Pkey Unique number corresponding to an Eos probeset
Ref Sequence source The 7 digit numbers in this column are Genbank Identifier (GI) numbers "Dunham I et al" refers to the publication entitled "The DNA sequence of human chromosome 22" Dunham, et al. (1999) Nature 402: 489–495
Strand Indicates DNA strand from which exons were predicted
Nt_position Indicates nucleotide positions of predicted exons Table 18A lists about 117 genes down-regulated in ovarian cancer compared to non-malignant adult ovaries. These were selected as for 17A, except that the numerator was set to the 75th percentile amongst various non-malignant ovary specimens, the denominator was set to the 96th percentile value amongst various ovarian cancers, the numerator was greater than or equal to 75 units, and the ratio was greater than or equal to 2 0 (i e, 2-fold downregulation in tumor vs. normal ovaries)

TABLE 18A

| Pkey | Ex Accn | UG ID | Title | Pred Protein Dom. | R1 |
|---|---|---|---|---|---|
| 428232 | BE272452 | Hs. 183109 | monoamine oxidase A | Amine_oxidase, pyr_redox, F | 16.9 |
| 433563 | AI732637 | Hs.277901 | ESTs | SS | 10.8 |
| 444931 | AV652066 | | general transcription factor l | SS, Glypican | 8.7 |
| 451573 | AW130351 | | ESTs | SS | 8.3 |
| 429570 | BE242256 | Hs. 2441 | KIAA0022 gene product | lectin_c, SS, TM | 7.9 |
| 453510 | AI699482 | Hs. 42151 | ESTs | SS | 7.5 |
| 410295 | AA741357 | | nidogen (enactin) | SS, EGF, ldl_recept_b, thyro | 6.9 |
| 438549 | BE386801 | Hs.21858 | tnnucleotide repeat containin | SS, serpin, SS, WD40, FYVE | 6.5 |
| 407969 | AA046217 | Hs.105370 | ESTs | SS, Pep_M12B_propep, Reprol | 6.2 |
| 414541 | BE293116 | Hs. 76392 | aldehyde dehydrogenase 1 famil | aldedh | 6.0 |
| 448438 | BE613081 | Hs. 24654 | Homo sapiens cDNA FLJ11640 fis | | 5.7 |
| 441422 | R43777 | Hs. 21364 | ESTs | SS, TM | 5.1 |
| 413391 | AI223328 | Hs.75335 | glycine amidinotransferase (L- | Amidinotransf | 3.9 |
| 428022 | Z39686 | Hs. 27865 | ESTs | SS | 3.6 |
| 423044 | AA320829 | Hs. 97266 | protocadhenn 18 | | 3.6 |
| 416039 | AA376989 | Hs. 78989 | alcohol dehydrogenase 5 (class | adh_zinc, HCV_NS4a, TM, adh_ | 3.5 |
| 452854 | AA437061 | Hs.14060 | prokineticin 1 precursor | SS | 3.4 |
| 436772 | AW975688 | | metallothionein 1E (functional | SS, TM,7tm_2, HRM | 3.2 |
| 415162 | AF035718 | Hs. 78061 | transcription factor 21 | HLH | 3.2 |
| 427794 | AA709186 | Hs. 99070 | ESTs | SS | 3.1 |
| 433072 | AI928037 | Hs. 158832 | ESTs | SS | 3.1 |
| 418318 | U47732 | Hs. 84072 | transmembrane 4 superfamily me | transmembrane4 | 2.9 |
| 410059 | NM_007038 | Hs.58324 | a disintegnn-like and metallo | Reprolysin, tsp_1, Pep_M12B | 2.9 |
| 431933 | AI187057 | Hs. 132554 | ESTs | TM, SS, TM | 2.9 |
| 420303 | AA258282 | Hs. 278436 | KIAA1474 protein | | 2.8 |
| 438780 | M64936 | | gb Homo sapiens retinoic acid- | | 2.8 |
| 427661 | AA410292 | Hs. 104761 | ESTs | SS, wnt | 2.8 |
| 437342 | AW903297 | Hs. 236438 | hypothetical protein DKFZp761K | Sec7, PH | 2.8 |
| 453828 | AW970960 | Hs. 293821 | ESTs | SS, Pep_M12B_propep, Reprol | 2.7 |
| 418444 | AI902899 | Hs.85155 | butyrate response factor 1 (EG | zf-CCCH, SS | 2.7 |
| 453767 | AB011792 | Hs. 35094 | extracelluler matrix protein 2 | vwc, LRR, SS, LRR | 2.7 |
| 413624 | BE177019 | Hs.75445 | SPARC-like 1 (mast9, hevin) | kazal, SS, kazal | 2.7 |
| 413305 | NM_000426 | Hs. 323511 | Homo sapiens cDNA FLJ23176 fi | laminin_B, laminin_EGF, lam | 2.7 |
| 414504 | AW069181 | Hs. 115175 | stenle-alpha motif and leucin | SS, pkinase, SAM | 2.7 |
| 439897 | NM_015310 | Hs. 6763 | KIAA0942 protein | Sec7, PH | 2.7 |
| 421639 | NM_012082 | Hs.106309 | Friend of GATA2 | SS | 2.7 |
| 442498 | U54617 | Hs.8364 | Homo sapiens pyruvate dehydrog | HATPase_c, HATPase_c | 2.6 |
| 410494 | M36564 | Hs. 64016 | protein S (alpha) | EGF, laminin_G, gla | 2.6 |
| 452958 | AA883929 | Hs. 40527 | ESTs | SS | 2.6 |

TABLE 18A-continued

| Pkey | Ex Accn | UG ID | Title | Pred Protein Dom. | R1 |
|---|---|---|---|---|---|
| 449648 | AW205607 | Hs. 253499 | ESTs | SS | 2.5 |
| 435519 | AI218950 | Hs. 125461 | hypothetical protein FLJ11539 | SS | 2.5 |
| 433690 | AI373949 | Hs. 279610 | hypothetical protein FLJ10493 | SS | 2.5 |
| 424319 | AW961026 | Hs.96752 | ESTs, Weakly similar to ALU8_H | | 2.5 |
| 420174 | AI824144 | Hs. 199749 | ESTs | | 2.5 |
| 421709 | AA159394 | Hs. 107056 | CED-6 protein | PID, Herpes_UL6 | 2.4 |
| 417622 | AW298163 | Hs.82318 | WAS protein family, member 3 | WH2 | 2.4 |
| 453655 | AW960427 | Hs. 342874 | transforming growth factor, be | SS, TM, zona_pellucida | 2.4 |
| 408468 | AI909712 | | phosphatidylinositol transfer | SS, PX, PH, PLDc, PH, PLDc, PX | 2.4 |
| 400829 | | | C11000244 gi|11056030|ref|NP_0 | SS, TM, SS, TFIID_30 kD | 2.3 |
| 453125 | AW779544 | Hs. 115497 | hypothetical protein FLJ22655 | ras | 2.3 |
| 437862 | AW978107 | Hs.5884 | *Homo sapiens* mRNA, cDNA DKFZp5 | HLH | 2.3 |
| 425462 | AI491852 | Hs.46783 | *Homo sapiens* cDNA FLJ22382 fi | | 2.3 |
| 417094 | NM_006895 | Hs. 81182 | histamine N-methyltransferase | Acyl-CoA_dh | 2.3 |
| 403247 | | | Target Exon | | 2.3 |
| 441916 | AA993571 | | ESTs | | 2.3 |
| 422746 | NM_004484 | Hs. 119651 | glypican 3 | Glypican, SS | 2.3 |
| 416777 | AF146760 | Hs.79844 | DKFZP564M1416 protein | SS, GTP_CDC, SS | 2.3 |
| 409403 | AA668224 | Hs. 6634 | *Homo sapiens* cDNA FLJ22547 fi | SS, TM | 2.3 |
| 418956 | AA234831 | | KIAA0788 protein | SS | 2.3 |
| 410073 | AW408163 | Hs.58488 | catenin (cadhenn-associated p | Vinculin, Stathmin | 2.3 |
| 419461 | AI452601 | Hs. 288869 | nuclear receptor subfamily 2, | hormone_rec, zf-C4, hormone | 2.3 |
| 429319 | AL023754 | Hs. 199068 | similar to calcium/calmodulin | SS, pkinase | 2.2 |
| 452123 | AI267615 | Hs. 38022 | ESTs | SS | 2.2 |
| 453305 | R39224 | Hs. 267997 | EHM2 gene | | 2.2 |
| 416157 | NM_003243 | Hs.342874 | transforming growth factor, be | zona_pellucida, SS, TM, zona | 2.2 |
| 406637 | U14966 | Hs.180946 | ribosomal protein L5 | Ribosomal_L18p | 2.2 |
| 414466 | AA349211 | Hs.76205 | cytochrome P450, subfamily XIA | p450 | 2.2 |
| 408915 | NM_016651 | Hs.48950 | heptacellular carcinoma novel | SS | 2.2 |
| 420929 | AI694143 | Hs. 326248 | programmed cell death 4 | MA3, LRR | 2.2 |
| 456972 | AI054347 | Hs. 2017 | ribosomal protein L38 | SS, TM | 2.2 |
| 409549 | AB029015 | Hs.54886 | phospholipase C, epsilon 2 | C2, PH, PI-PLC-Y, PI-PLC-X | 2.2 |
| 410209 | AI583661 | Hs. 60548 | hypothetical protein PRO1635 | SS, TM, Fork_head | 2.2 |
| 449500 | AW956345 | Hs. 12926 | ESTs | SS, TM | 2.2 |
| 447806 | W03616 | Hs. 10432 | ESTs, Weakly similar to I38022 | | 2.1 |
| 441712 | AW391927 | Hs.7946 | KIAA1288 protein | | 2.1 |
| 445025 | AI768895 | Hs. 295727 | ESTs, Weakly similar to ALUB_H | SS, BAG, UPF0001 | 2.1 |
| 444161 | N52543 | Hs. 142940 | ESTs | SS | 2.1 |
| 427156 | BE621719 | Hs. 173802 | KIAA0603 gene product | SS, TM, TBC | 2.1 |
| 436995 | AI160015 | Hs. 125489 | ESTs | SS, TM, RasGEF, actin, RasGEF | 2.1 |
| 408443 | N33937 | Hs. 10336 | ESTs | SS | 2.1 |
| 448274 | AI268097 | Hs. 67317 | *Homo sapiens* cDNA FLJ11775 fis | | 2.1 |
| 426354 | NM_004010 | Hs.169470 | dystrophin (muscular dystrophy | ZZ, CH, WW, spectrin, bZIP, SS | 2.1 |
| 443906 | AA348031 | Hs. 7913 | ESTs | | 2.1 |
| 444815 | AA151539 | Hs.1227 | aminolevulinate, delta-, dehyd | SS, ALAD | 2.1 |
| 420728 | AA767718 | Hs. 93581 | hypothetical protein FLJ10512 | SS, TM, Sema, PSI, ig | 2.1 |
| 404245 | | | NM_007116* | fibrinogen_C, fn3, SS | 2.1 |
| 436420 | AA443966 | Hs.31595 | ESTs | SS, TM, PMP22_Claudin, SS, TM | 2.1 |
| 410066 | AL117664 | Hs. 58419 | DKFZP586L2024 protein | | 2.0 |
| 414476 | AA301867 | Hs. 76224 | EGF-containing fibulin-like ex | EGF, TIL, SS | 2.0 |
| 424137 | AA335769 | Hs. 16262 | ESTs | | 2.0 |
| 447659 | AA017472 | Hs. 107260 | hypothetical protein DKFZp586H | SS | 2.0 |
| 444862 | AI209158 | Hs.143929 | ESTs | SS, TM | 2.0 |
| 426086 | T94907 | Hs.188572 | ESTs | PH, CH, spectrin | 2.0 |
| 436080 | AI684710 | Hs.201645 | ESTs | SS, ATP-synt_C | 2.0 |
| 424651 | AI493206 | | ESTs | SS | 2.0 |
| 432939 | AL038924 | Hs. 279849 | KIAA0438 gene product | zf-C3HC4, myosin_head, DIL, | 2.0 |
| 449088 | AI654048 | Hs. 196556 | ESTs | SS, MACPF, sushi, ldl_recept | 2.0 |
| 428642 | NM_014899 | Hs. 10432 | KIAA0878 protein | BTB, ras | 2.0 |
| 419577 | L36531 | Hs. 91296 | integrin, alpha 8 | TM, integrin_A, FG-GAP | 2.0 |
| 450435 | AI695975 | Hs.201805 | ESTs | laminin_B, laminin_EGF, lam | 2.0 |
| 450696 | AI654223 | Hs. 16026 | hypothetical protein FLJ23191 | SS | 2.0 |
| 421255 | BE326214 | Hs. 93813 | ESTs | TM | 2.0 |
| 432467 | T03667 | Hs.239388 | Human DNA sequence from clone | SS | 2.0 |
| 408654 | BE018882 | Hs. 46721 | UCC1 protein | SS, Ependymin, SS | 2.0 |
| 412611 | AA732036 | Hs. 164478 | hypothetical protein FLJ21939 | | 2.0 |
| 453355 | AW295374 | Hs. 31412 | myopodin | | 2.0 |
| 424665 | AW368576 | Hs. 139851 | caveolin 2 | SS, TM, Caveolin, Caveolin | 2.0 |
| 458147 | AW752597 | | gb IL3-CT0214-161299-045-B06 C | SS, TM, PMM | 2.0 |
| 447566 | N50432 | Hs.102648 | ESTs | | 2.0 |
| 414496 | W73853 | | ESTs | SS, TM, pkinase, F5_F8_type_ | 2.0 |
| 425618 | AW119112 | Hs.9052 | *Homo sapiens* cDNA FLJ22042 fi | SS, TM | 2.0 |
| 415166 | NM_003652 | Hs. 78068 | carboxypeptidase Z | Zn_carbOpept, Fz, Dioxygena | 2.0 |
| 422157 | AW957295 | Hs. 112318 | 6.2 kd protein | SS | 2.0 |
| 450253 | AL133047 | Hs.24715 | *Homo sapiens* mRNA, cDNA DKFZp4 | SH3 | 2.0 |

TABLE 18A-continued

| Pkey | Ex Accn | UG ID | Title | Pred Protein Dom. | R1 |
|---|---|---|---|---|---|
| 418919 | AA232635 | | ESTs | SS, DUF25 | 2.0 |
| 444846 | AI871055 | Hs. 148477 | ESTs | SS, TM | 2.0 |
| 418781 | T41160 | Hs. 8404 | ESTs | | 2.0 |

Pkey: Unique Eos probeset identifier number
Ex Accn: Exemplar Accession number, Genbank accession number
UG ID UniGene number
Title. UniGene gene title
Pred. Protein Dom.: Predicted protein domain
R1: Ratio of normal ovaries to tumor

TABLE 18B

| Pkey | CAT Number | Accession |
|---|---|---|
| 408468 | 106033_1 | AI909712 AL039752 BE000369 AA376876 N75269 AA345398 AA349053 AW960062 R76169 R70638 AA054770 AI378587 AI338002 AI762398 N47873 AI066549 AI474112 AW450680 AA668668 R76114 AW242828 N58855 AW080313 AI378491 AI807102 AA417043 AI565444 AW263286 AW297099 |
| 410295 | 11922_2 | AA741357 AI870000 W75997 H50726 AV658709 AI498817 AL037804 W67847 BE018553 AI033256 N76810 N31548 AI032084 N36278 AW075272 AI032081 R35753 W93372 AA700790 AI903697 N52985 R82468 AW580252 AL036760 AI052219 R36621 W07047 AA088621 AI249109 W68776 W69374 AA15 |
| 414496 | 145392_1 | W73853 AA928112 W77887 AW889237 AA148524 AI749182 AI754442 AI338392 AI253102 AI079403 AI370541 AI697341 H97538 AW188021 AI927669 W72716 AI051402 AI188071 AI335900 N21488 AW770478 W92522 AI691028 AI913512 AI144448 W73819 AA604358 N28900 W95221 AI868132 H98 |
| 418919 | 180623_1 | AA232635 AI373703 AA233330 |
| 418956 | 180862_1 | AA234831 AI700302 AA906216 AA776957 R49415 AI420777 AA666394 AI830619 AA779469 AI972390 N40980 AI094453 AA826397 AA535994 AI868257 AI804295 AA897791 AA232893 AI348680 AI356232 AA235138 F31396 AW079977 H16405 |
| 424651 | 241981_1 | AI493206 AA732315 AA344619 AA904035 AW952967 AA488889 AA635644 BE245127 AA669979 AA761874 H28767 AA910081 AA837086 AA766495 W76175 AI521825 AA746092 AA743152 AI478562 H88863 |
| 436772 | 426854_1 | AW975688 AA731063 N67084 |
| 438780 | 46501_1 | M64936 AI025512 AI382987 BE061777 AA089966 BE169930 T41176 AW594624 BE502415 AA121893 AI269283 T40311 AI684569 AA257011 AI079277 AI241318 BE327710 AW975215 AW896268 AA884990 BE327514 |
| 441916 | 528799_1 | AA993571 AA971518 AI937262 |
| 444931 | 62567_1 | AV652066 AA459880 T58512 T58561 AI651255 N49838 H87921 AW264447 AA428067 AA364094 AW955685 D62894 AW341452 AA243652 AI984618 AA456147 AI784566 AI003975 AI277917 AI149141 AA456147 AI784566 AI003975 AI245674 AI433703 AI200208 AI268985 AI38 |
| 451573 | 875588_1 | AW130351 AW338699 AI803973 |
| 458147 | 488021_1 | AW752597 AW848781 AW849062 AW848490 AW752699 AW752604 AW752700 |

Pkey Unique Eos probeset identifier number
CAT number Gene cluster number
Accession Genbank accession numbers

TABLE 18C

| Pkey | Ref | Strand | Nt_position |
|---|---|---|---|
| 400829 | 8570385 | Plus | 152176–152616 |
| 403247 | 7656833 | Minus | 76626–77140 |
| 404245 | 7406725 | Plus | 36019–36282, 37073–37813, 38946–39314, 40355–40651, 42738–43028, 43391–43696, 45698–46030, 51110–51415, 52779–53072, 54648–54935, 55201–55509, 55926–56240, 56355–56672, 57078–57401, 59966–60262, 62600–62926, 63363–63686, 66693–67025, 68180–68497, 68909–69232, 71372–71695, 720 |

Pkey: Unique number corresponding to an Eos probeset
Ref Sequence source. The 7 digit numbers in this column are Genbank Identifier (GI) numbers "Dunham I et al." refers to the publication entitled "The DNA sequence of human chromosome 22" Dunham, et al. (1999) Nature 402 489–495
Strand Indicates DNA strand from which exons were predicted
Nt_position Indicates nucleotide positions of predicted exons Table 19A provides UnigeneID, Unigene Title, Pkey, and Exemplar Accession for sequences in Table 20 Information in Table 19A is linked by SEQ ID NO to Table 20

TABLE 19A

| Pkey | ExAccn | UG ID | Title | SEQ ID NO |
|---|---|---|---|---|
| 452838 | U65011 | Hs 30743 | preferentially expressed antigen in mela | SEQ ID NO: 1–2 |
| 421478 | AI683243 | Hs 97258 | ESTs, Moderately similar to S29539 ribos | SEQ ID NO 3–4 |
| 436982 | AB018305 | Hs. 5378 | spondin 1, (f-spondin) extracellular mat | SEQ ID NO 5–6 |
| 458627 | AW088642 | Hs 97984 | SRY (sex determining region Y)-box 17 (S | SEQ ID NO 7–8 |
| 422956 | BE545072 | Hs 122579 | ECT2 protein (Epithelial cell transform | SEQ ID NO: 9–10 |
| 410102 | AW248508 | Hs. 279727 | ESTs, homologue of PEM-3 [Ciona savignyi | SEQ ID NO 11–12 |
| 428579 | NM_005756 | Hs 184942 | G protein-coupled receptor 64 | SEQ ID NO 13–22 |
| 428227 | AA321649 | Hs 2248 | smell inducible cytokine subfamily B (Cy | SEQ ID NO 23–24 |
| 451110 | AI955040 | Hs 265398 | PAR-6 beta (partitioning defective 6 h | SEQ ID NO 25–26 |
| 428187 | AI687303 | Hs 285529 | G protein-coupled receptor 49 | SEQ ID NO: 27–28 |
| 424905 | NM_002497 | Hs. 153704 | NIMA (never in mitosis gene a)-related k | SEQ ID NO 29–30 |
| 433159 | A8035898 | Hs 150587 | kinesin-like protein 2 | SEQ ID NO: 31–32 |
| 426427 | M86699 | Hs 169840 | TTK protein kinase | SEQ ID NO: 33–34 |
| 425371 | D49441 | Hs 155981 | mesothelin | SEQ ID NO: 35–38 |
| 418506 | AA084248 | Hs 85339 | G protein-coupled receptor 39 | SEQ ID NO: 39–40 |
| 456546 | AI690321 | Hs 203845 | KCNK15 potassium channel, subfamily K, m | SEQ ID NO: 41–42 |
| 427344 | NM_000869 | Hs 2142 | 5-hydroxytryptamine (serotonin) receptor | SEQ ID NO 43–44 |
| 445237 | AJ245671 | Hs. 12844 | EGE-like-domain, multiple 6 | SEQ ID NO 45–46 |
| 424620 | AA101043 | Hs 151254 | kallikrein 7 (chymotryptic, stratum corn | SEQ ID NO 47–48 |
| 412078 | X69699 | Hs 73149 | paired box gene 8 | SEQ ID NO: 49–52 |
| 409178 | BE393948 | Hs 50915 | kallikrein 5 | SEQ ID NO: 53–54 |
| 448243 | AW369771 | | integrin, beta 8 | SEQ ID NO 55–56 |
| 426514 | BE616633 | Hs 170195 | bone morphogenetic protein 7 (osteogenic | SEQ ID NO 57–58 |
| 419452 | U33635 | Hs 90572 | PTK7 protein tyrosine kinase 7 | SEQ ID NO 59–60 |
| 431130 | NM_006103 | Hs. 2719 | HE4, epididymia-specific, whey-acidic pr | SEQ ID NO 61–62 |
| 415539 | AI733881 | Hs 72472 | BMP-R1B | SEQ ID NO 63–64 |
| 423961 | D13666 | Hs 136348 | periostin (OSF-2os) | SEQ ID NO 65–66 |
| 417433 | BE270266 | Hs 82128 | 5T4 oncofetal trophoblast glycoprotein | SEQ ID NO 67–68 |
| 422867 | L32137 | Hs 1584 | cartilage oligomeric matrix protein (pse | SEQ ID NO: 69–70 |
| 409542 | AA503020 | Hs 36563 | hypothetical protein FLJ22418 | SEQ ID NO 71–72 |
| 444381 | BE387335 | Hs 283713 | ESTs, Weakly similar to S64054 hypotheti | SEQ ID NO 73–74 |
| 452747 | BE153855 | Hs. 61460 | Ig superfamily receptor LNIR | SEQ ID NO 75–76 |
| 450375 | AA009647 | | a disintegrin and metalloproteinase doma | SEQ ID NO 77–78 |
| 426215 | AW963419 | Hs 155223 | stanniocalcin 2 | SEQ ID NO 79–80 |
| 430044 | AA464510 | Hs 152812 | ESTs | SEQ ID NO: 81 |
| 447033 | AI357412 | Hs 157601 | ESTs | SEQ ID NO 82–87 |
| 410418 | D31382 | Hs. 63325 | transmembrane protease, serine 4 | SEQ ID NO 88–89 |
| 411274 | NM_002776 | Hs 69423 | kallikrein 10 | SEQ ID NO 90–91 |
| 422260 | AA315993 | Hs 105484 | regenerating gene type IV | SEQ ID NO: 92–93 |
| 409041 | AB033025 | Hs. 50081 | Hypothetical protein, XP_051860 (KIAA119 | SEQ ID NO 94–95 |
| 428664 | AK001666 | Hs 189095 | similar to SALL1 (sal (Drosophila)-like | SEQ ID NO 96–97 |
| 404977 | | | Insulin-like growth factor 2 (somatomedi | SEQ ID NO 98–99 |
| 427747 | AW411425 | Hs 180655 | serine/threonine kinase 12 | SEQ ID NO 100–101 |
| 412140 | AA219691 | Hs 73625 | RAB6 interacting, kinesin-like (rabkines | SEQ ID NO: 102–103 |
| 431846 | BE019924 | Hs 271580 | uroplakin 1B | SEQ ID NO: 104–105 |
| 425465 | L18964 | Hs 1904 | protein kinase C, iota | SEQ ID NO: 106–107 |
| 432938 | T27013 | Hs 3132 | steroidogenic acute regulatory protein | SEQ ID NO 108–109 |
| 421451 | AA291377 | Hs. 50831 | ESTs | SEQ ID NO 110–117 |
| 437478 | AL390172 | Hs 317432 | branched chain aminotransferase 1, cytos | SEQ ID NO 116–119 |
| 411945 | AL033527 | Hs 92137 | L-myc-2 protein (MYCL2) | SEQ ID NO 120–121 |
| 424078 | AB006625 | Hs 139033 | paternally expressed 3 | SEQ ID NO 122–123 |
| 406400 | | | kallikrein 8 (neuropsin/ovasin) (KLK8) | SEQ ID NO: 124–125 |
| 428450 | NM_014791 | Hs 184339 | KIAA0175 gene product | SEQ ID NO 126–127 |
| 438167 | R28363 | Hs 24286 | chemokine binding protein 2 (CCBP2), mRN | SEQ ID NO 128–129 |
| 416530 | U62801 | Hs. 79361 | kallikrein 6 (neurosin, zyme) | SEQ ID NO: 130–131 |
| 430691 | C14187 | Hs 157208 | anstaless-related homeobox protein ARX | SEQ ID NO 132–133 |
| 408081 | AW451597 | Hs 167409 | intron of basic-helix-loop-helix-PAS pro | SEQ ID NO 134 |
| 411773 | NM_006799 | Hs 72026 | protease, serine, 21 (testisin) | SEQ ID NO: 135–138 |
| 407792 | AI077715 | Hs. 39384 | putative secreted ligand homologous to f | SEQ ID NO 139–140 |
| 428093 | AW594506 | Hs. 104830 | ESTs | SEQ ID NO 141–144 |
| 431630 | NM_002204 | Hs 265829 | integrin, alpha 3 (antigen CD49C, alpha | SEQ ID NO 145–148 |
| 421502 | AF111856 | Hs 105039 | solute carrier family 34 (sodiam phospha | SEQ ID NO 149–150 |
| 431441 | U81961 | Hs 2794 | sodium channel, nonvoltage-gated 1 alpha | SEQ ID NO 151–152 |
| 431369 | BE184455 | Hs 251754 | secretory leukocyte protease inhibitor ( | SEQ ID NO 153–154 |
| 436972 | AA284679 | Hs 25640 | claudin 3 | SEQ ID NO: 155–156 |
| 429504 | X99133 | Hs. 204238 | lipocalin 2 (oncogene 24p3) (NGAL) | SEQ ID NO 157–158 |
| 410001 | AB041036 | Hs 57771 | kallikrein 11 | SEQ ID NO 159–160 |

Pkey: Unique Eos probeset identifier number
ExAccn Exemplar Accession number, Genbank accession number
UG ID: UniGene number
Title: UniGene gene title
SEQ ID NO: Sequence Identification number for sequences in Table 20

TABLE 19B

| Pkey | CAT Number | Accession |
|---|---|---|
| 448243 | 75629_1 | AW369771 AW748174 AA290801 AA419198 AA044331 AA127909 AW995442 AI480343 AA044582 AW956159 AA373451 AA127965 AL134913 AW994956 BE622314 BE006298 BE006312 BE006305 BE006317 BE006303 AA043906 AA234175 AA479726 |
| 450375 | 83327_1 | AA009647 AA131254 AA374293 AW954405 H04410 AW606284 AA151166 BE157467 BE157601 H04384 W46291 AW663674 H04021 H01532 AA190993 H03231 H59605 H01642 AA852876 AA113758 AA626915 AA746952 AI161014 AA099554 R69067 |
| Pkey | | Unique Eos probeset identifier number |
| CAT number | | Gene cluster number |
| Accession | | Genbank accession numbers |

TABLE 19C

| Pkey | Ref | Strand | Nt_position |
|---|---|---|---|
| 404977 | 3738341 | Minus | 43081–43229 |
| 406400 | 9256298 | Plus | 1553–1712, 1878–2140, 4252–4385, 5922–6077 |

| | |
|---|---|
| Pkey: | Unique number corresponding to an Eos probeset |
| Ref | Sequence source. The 7 digit numbers in this column are Genbank Identifier (GI) numbers. "Dunham I et al." refers to the publication entitled "The DNA sequence of human chromosome 22" Dunham, et al. (1999) Nature 402:489–495 |
| Strand | Indicates DNA strand from which exons were predicted |
| Nt_position | Indicates nucleotide positions of predicted exons |

TABLE 20

```
SEQ ID NO: 1 DNA sequence
Nucleic Acid Accession #. NM_006115.1
Coding sequence. 236..1765
1          11         21         31         41         51
|          |          |          |          |          |
GCTTCAGGGT ACAGCTCCCC CGCAGCCAGA AGCCGGGCCT GCAGCCCCTC AGCACCGCTC   60

CGGGACACCC CACCCGCTTC CCAGGCGTGA CCTGTCAACA GCAACTTCCC GGTCTGGTGA  120

ACTCTCTGAG GAAAAACCAT TTTGATTATT ACTCTCAGAC GTGCGTGGCA ACAAGTGACT  180

GAGACCTAGA AATCCAAGCG TTGGAGGTCC TGAGGCCAGC CTAAGTCGCT TCAAAATGGA  240

ACGAAGGCGT TTGTGGGGTT CCATTCAGAG CCGATACATC AGCATGAGTG TGTGGACAAG  300

CCCACGGAGA CTTGTGGAGC TGGCAGGGCA GAGCCTGCTG AAGGATGAGG CCCTGGCCAT  360

TGCCGCCCTG GAGTTGCTGC CAGGGAGCT CTTCCCGCCA CTCTTCATGG CAGCCTTTGA  420

CGGGAGACAC AGCCAGACCC TGAAGGCAAT GGTGCAGGCC TGGCCCTTCA CCTGCCTCCC  480

TCTGGGAGTG CTGATGAAGG GACAACATCT TCACCTGGAG ACCTTCAAAG CTGTGCTTGA  540

TGGACTTGAT GTGCTCCTTG CCCAGGAGGT TCGCCCCAGG AGGTGGAAAC TTCAAGTGCT  600

GGATTTACGG AAGAACTCTC ATCAGGACTT CTGGACTGTA TGGTCTGGAA ACAGGGCCAG  660

TCTGTACTCA TTTCCAGAGC CAGAAGCAGC TCAGCCCATG ACAAAGAAGC GAAAAGTAGA  720

TGGTTTGAGC ACAGAGGCAG AGCAGCCCTT CATTCCAGTA GAGGTGCTCG TAGACCTGTT  780

CCTCAAGGAA GGTGCCTGTG ATGAATTGTT CTCCTACCTC ATTGAGAAAG TGAAGCGAAA  840

GAAAAATGTA CTACGCCTGT GCTGTAAGAA GCTGAAGATT TTTGCAATGC CCATGCAGGA  900

TATCAAGATG ATCCTGAAAA TGGTGCAGCT GGACTCTATT GAAGATTTGG AAGTGACTTG  960

TACCTGGAAG CTACCCACCT TGGCGAAATT TTCTCCTTAC CTGGGCCAGA TGATTAATCT 1020

GCGTAGACTC CTCCTCTCCC ACATCCATGC ATCTTCCTAC ATTTCCCCGG AGAAGGAAGA 1060

GCAGTATATC GCCCAGTTCA CCTCTCAGTT CCTCAGTCTG CAGTGCCTGC AGGCTCTCTA 1140

TGTGGACTCT TTATTTTTCC TTAGAGGCCG CCTGGATCAG TTGCTCAGGC ACGTGATGAA 1200

CCCCTTGGAA ACCCTCTCAA TAACTAACTG CCGGCTTTCG GAAGGGGATG TGATGCATCT 1260

GTCCCAGAGT CCCAGCGTCA GTCAGCTAAG TGTCCTGAGT CTAAGTGGGG TCATGCTGAC 1320

CGATGTAAGT CCCGAGCCCC TCCAAGCTCT GCTGGAGAGA GCCTCTGCCA CCCTCCAGGA 1380

CCTCGTCTTT GATGAGTGTG GGATCACGGA TGATCAGCTC CTTGCCCTCC TGCCTTCCCT 1440
```

TABLE 20-continued

```
GAGCCACTGC TCCCAGCTTA CAACCTTAAG CTTCTACGGG AATTCCATCT CCATATCTGC  1500

CTTGCAGAGT CTCCTGCAGC ACCTCATCGG GCTGAGCAAT CTGACCCACG TGCTGTATCC  1560

TGTCCCCCTG GAGAGTTATG AGGACATCCA TGGTACCCTC CACCTGGAGA GGCTTGCCTA  1620

TCTGCATGCC AGGCTCAGGG AGTTGCTGTG TGAGTTGGGG CGGCCCAGCA TGGTCTGGCT  1680

TAGTGCCAAC CCCTGTCCTC ACTGTGGGGA CAGAACCTTC TATGACCCGG AGCCCATCCT  1740

GTGCCCCTGT TTCATGCCTA ACTAGCTGGG TGCACATATC AAATGCTTCA TTCTGCATAC  1800

TTGGACACTA AAGCCAGGAT GTGCATGCAT CTTGAAGCAA CAAAGCAGCC ACAGTTTCAG  1860

ACAAATGTTC AGTGTGAGTG AGGAAAACAT GTTCAGTGAG GAAAAAACAT TCAGACAAAT  1920

GTTCAGTGAG GAAAAAAAGG GGAAGTTGGG GATAGGCAGA TGTTGACTTG AGGAGTTAAT  1980

GTGATCTTTG GGGACATACA TCTTATAGAG TTAGAAATAG AATCTGAATT TCTAAAGGGA  2040

GATTCTGGCT TGGGAAGTAC ATGTAGGAGT TAATCCCTGT GTAGACTGTT GTAAAGAAAC  2100

TGTTGAAAAT AAAGAGAAGC AATGTGAAGC AAAAAAAAAA AAAAAAAA

SEQ ID NO: 2 Protein sequence
Protein Accession #: NP_006106.1
1          11         21         31         41         51
|          |          |          |          |          |
MERRELMGSI QSRYISMSVW TSPRELVELA GQSLLKDEAL AIAALELLPR ELFPPLFMAA   60

FDGRHSQTLK AMVQAWPFTC LPLGVLMKGQ HLHLETFKAV LDGLDVLLAQ EVRPRRWKLQ  120

VLDLRKNSNQ DPWTVWSGNR ASLYSFPEPE AAQPMTKKRK VDGLSTEASQ PFIPVEVLVD  180

LFLKEGACDE LFSYLIEKVK RKKNVLRLCC KKLKIFAMPM QDIKMILKMV QLDSIEDLEV  240

TCTWKLPTLA KESPYLGQMI NLRRLLLSHI HASSYISPEK EEQYIAQFTS QFLSLQCLQA  300

LYVDSLFFLR GRLDQLLRHV MNPLETLSIT NCRLSEGDVN HLSQSPSVSQ LSVLSLSGVM  360

LTDVSPEPLQ ALLERASATL QDLVFDECGI TDDQLLALLP SLSHCSQLTT LSFYGNSISI  420

SALQSLLQHL IGLSNLTHVL YPVPLESYED IHGTLHLERL AYLHARLREL CELGRPSMV   480

WLSANPCPHC GDRTFYDPEP ILCPCFMPN

SEQ ID NO: 3 DNA sequence
Nucleic Acid Accession #. Eos sequence
Coding sequence: 264..782
1          11         21         31         41         51
|          |          |          |          |          |
CCCTGCTCCA GTCACACCCG GAAGCTGACT GGTCCACGCA CAGCTGAAGC ATGAGGAAAC   60

TCATCGCGGG ACTAATTTTC CTTAAAATTT AGACTTGCAC AGTAAGGACT TCAACTGACC  120

TTCCTCAGAC TGAGAACTGT TTCCAGTATA TACATCAAGT CACTGAGATC TCCAGCACCC  180

TGCCGGTGGC ACTACTGAGA GACGAGGTGC CAGGGTGGTT CCTGAAAGTG CCTGAGCCCC  240

AACTTATCAG CAAGGAGCTC ATCATGCTGA CAGAAGTCAT GGAGGTCTGG CATGGCTTAG  300

TGATCGCGGT GGTGTCCCTC TTCCTGCAGG CCTGCTTCCT CACCGCCATC AACTACCTGC  360

TCAGCAGGCA CATGGCCCAC AAGAGTGAAC AGATACTGAA AGCGGCCAGT CTCCAGGTTC  420

CCAGGCCCAG CCCTGGCCAC CATCATCCAC CTGCTGTCAA AGAGATGAAG GAGACTCAGA  480

CAGAGAGAGA CATCCCAATG TCTGATTCCC TTTACAGGCA TGACAGCGAC ACACCCTCAG  540

ATAGCTTGGA TAGCTCCTGC AGTTCGCCTC CTGCCTGCCA GGCCACAGAG GATGTGGATT  600

ACACACAAGT CGTCTTTTCT GACCCTGGAG AACTAAAAAA TGACTCCCCG CTGGACTATG  660

AGAACATAAA GGAAATCACA GATTATGTCA ATGTCAATCC AGAAGACAC AAGCCCAGTT  720

TCTGGTATTT TGTCAACCCT GCTCTGTCTG AGCCAGCGGA ATATGATCAA GTGGCCATGT  780

GAATTCCAAA TATTTTTAAT GGGGTCCAGT TCTCTATGGA TTCTTACATT TAATTTGTAG  840
```

TABLE 20-continued

```
GGAAATGCCA TTTTTCCCCC TTAAACAAGG CATGGGCTC  ACAAGTCTAT GGAGACAGGC   900

CAAAAAGAAT GTGGAGAAGA AAACTGATAA ATACACAGAG GTCCTCAAGA CCCATGGACT   960

CCTGGTCTGT ACCCAAAAAA GCTGTTCGTT CCTCAAAAAC AAAAACAAGG CTTGGCTGGG  1020

AAAACAGGCC AATGCCCCGG CAAGAAAGGT TGAGATCAGA TGTTAGGAAG AACTTTCAGG  1080

TAAAGTATGA GAACTATGGA GTCCATCAGC AGAGATAGTA GTGAAGTCTC TCCCCAGGGA  1140

AAATTTTAAA AAGGTTGAAT CAGCTGTTGT AGAGTTCTAT TTGGCAATCT CATGGTTAAA  1200

TGACTTCCCT TTGAGCTCTT TAATTATTGG CAATAAACAA CTTCTTTAAA AGTTTTAAAT  1260

AAAATAGCAA CCACCACCA

SEQ ID NO: 4 Protein sequence
Protein Accession #: Eos sequence
1          11         21         31         41         51
|          |          |          |          |          |
MLTEVMEVWH GLVIAVVSLF LQACFLTAIN YLLSRHMAHK SEQILKAASL QVPRPSPGHH  60

HPPAVKENKE TQTERDIPMS DSLYRHDSDT PSDSLDSSCS SPPACQATED VDYTQVVFSD 120

PGELKNDSPL DYENIKEITD YVNVNPERHK PSFWYFVNPA LSEPAEYDQV AM

SEQ ID NO: 5 DNA sequence
Nucleic Acid Accession #: AB051390
Coding sequence. 34..2457
1          11         21         31         41         51
|          |          |          |          |          |
AGCGGCCGCG GCACAAAGTT GGGGGCCGCG AAGATGAGGC TGTCCCCGGC GCCCCTGAAG   60

CTGAGCCGGA CTCCGGCACT GCTGGCCCTG GCGCTGCCCC TGGCCGCGGC GCTGGCCTTC  120

TCCGACGAGA CCCTGGACAA AGTGCCCAAG TCAGAGGGCT ACTGCAGCCG TATCCTGCGC  180

GCCCAGGGCA CGCGGCGCGA GGGCTACACC GAGTTCAGCC TCCGCGTGGA GGGCGACCCC  240

GACTTCTACA AGCCGGGAAC CAGCTACCGC GTAACACTTT CAGCTGCTCC TCCCTCCTAC  300

TTCAGAGGAT TCACATTAAT TGCCCTCAGA GAGAACAGAG AGGGTGATAA GGAAGAAGAC  360

CATGCTGGGA CCTTCCAGAT CATAGACGAA GAAGAAACTC AGTTTATGAG CAATTGCCCT  420

GTTGCAGTCA CTGAAAAGCAC TCCACGGAGG AGGACCCGGA TCCAGGTGTT TTGGATAGCA  480

CCACCAGCGG AACAGGCTG  CGTGATTCTG AAGGCCAGCA TCGTACAAAA ACGCATTATT  540

TATTTTCAAG ATGAGGGCTC TCTGACCAAG AAACTTTGTG AACAAGATTC ACATTTGAT  600

GGGGTGACTG ACAAACCCAT CTTAGACTGC TGTGCCTGCG GAACTGCCAA GTACAGACTC  660

ACATTTTATG GGAATTGGTC CGAGAAGACA CACCCAAAGG ATTACCCTCG TCGGGCCAAC  720

CACTGGTCTG CGATCATCGG AGGATCCCAC TCCAAGAATT ATGTACTGTG GAATATGGA  780

GGATATGCCA GCGAAGGCGT CAAACAAGTT GCAGAATTGG GCTCACCCGT GAAAATGGAG  840

GAAGAAATTC GACAACAGAG TGATGAGGTC CTCACCGTCA TCAAAGCCAA AGCCCAATGG  900

CCAGCCTGGC AGCCTCTCAA CGTGAGAGGA GCACCTTCAG CTGAATTTTC CGTGGACAGA  960

ACGCGCCATT TAATGTCCTT CCTGACCATG ATGGGCCCTA GTCCCGACTG GAACGTAGGC 1020

TTATCTGCAG AAGATCTGTG CACCAAGGAA TGTGGCTGGG TCCAGAAGGT GGTGCAAGAC 1080

CTGATTCCCT GGGACGCTGG CACCGACAGC GGGGTGACCT ATGAGTCACC CAACAAACCC 1140

ACCATTCCCC AGGAGAAAAT CCGGCCCCTG ACCACCCTGG ACCATCCTCA GAGTCCTTTC 1200

TATGACCCAG AGGGTGGGTC CATCACTCAA GTACCCAGAG TTGTCATCGA GAGAATCGCA 1260

CGGAAGGGTG AACAATGCAA TATTGTACCT GACAATGTCG ATGATATTGT AGCTGACCTG 1320

GCTCCAGAAG AGAAAGATGA AGATGACACC CCTGAAACCT GCATCTACTC CAACTGGTCC 1380

CCATGGTCCG CCTGCAGCTC CTCCACCTGT GACAAAGGCA AGAGGATGCG ACAGCGCATG 1440
```

TABLE 20-continued

```
CTGAAAGCAC AGCTGGACCT CAGCGTCCCC TGCCCTGACA CCCAGGACTT CCAGCCCTGC 1500

ATGGGCCCTG GCTGCAGTGA CGAAGACGGC TCCACCTGCA CCATGTCCGA GTGGATCACC 1560

TGGTCGCCCT GCAGCATCTC CTGCGGCATG GGCATGAGGT CCCGGGAGAG GTATGTGAAG 1620

CAGTTCCCGG AGGACGGCTC CCTGTGCACG CTGCCCACTG AGGAAACGGA GAAGTGCACG 1680

GTCAACGAGG AGTGCTCTCC CAGCAGCTGC CTGATGACCG AGTGGGGCGA GTCGGACGAG 1740

TGCAGCGCCA CCTGCGGCAT GGGCATGAAG AAGCGGCACC GCATCATCAA GATGAACCCC 1800

GCAGATGGCT CCATGTGCAA AGCCGAGACA TCACAGGCAG AGAAGTGCAT GATGCCAGAG 1860

TGCCACACCA TCCCATGCTT GCTGTCCCCA TGGTCCGAGT GGAGTGACTG CACCGTGACC 1920

TGCGGGAAGG GCATGCGAAC CCGACAGCGG ATGCTCAAGT CTCTGGCAGA ACTTGGAGAC 1980

TGCAATGAGG ATCGGAGCA GGTGGAGAAG TGCATGCTCC CTGAATGCCC CATTGACTGT 2040

GAGCTCACCG AGTGGTCCCA GTGGTCGGAA TGTAACAAGT CATGTGGGAA AGGCCACGTG 2100

ATTCGAACCC GGATGATCCA AATGGAGCCT CAGTTTGGAG GTGCACCCTG CCCAGAGACT 2160

GTGCAGCGAA AAAAGTGCCG CATCCGAAAA TGCCTTCGAA ATCCATCCAT CCAAAAGCTA 2220

CGCTGGAGGG AGGCCCGAGA GAGCCGGCGG AGTGAGCAGC TGAAGGAAGA GTCTGAAGGG 2280

GAGCAGTTCC CAGGTTGTAG GATGCGCCCA TGGACGGCCT GGTCAGAATG CACCAAACTG 2340

TGCGGAGGTG GAATTCAGGA ACGTTACATG ACTGTAAAGA AGAGATTCAA AAGCTCCCAG 2400

TTTACCAGCT GCAAAGACAA GAAGGAGATC AGAGCATGCA ATGTTCATCC TTGTTAGCAA 2460

GGGTACGAGT TCCCCAGGGC TGCACTCTAG ATTCCAGAGT CACCAATGGC TGGATTATTT 2520

GCTTGTTTAA GACAATTTAA ATTGTGTACG CTAGTTTTCA TTTTTGCAGT GTGGTTCGCC 2580

CAGTAGTCTT GTGGATGCCA GAGACATCCT TTCTGAATAC TTCTTGATGG GTACAGGCTG 2640

AGTGGGCGC CCTCACCTCC AGCCAGCCTC TTCCTGCAGA GGAGTAGTGT CAGCCACCTT 2700

GTACTAAGCT GAAACATGTC CCTCTGGAGC TTCCACCTGG CCAGGGAGGA CGGAGACTTT 2760

GACCTACTCC ACATGGAGAG GCAACCATGT CTGGAAGTGA CTATGCCTGA GTCCCAGGGT 2820

GCGGCAGGTA GGAAACATTC ACAGATGAAG ACAGCAGATT CCCCACATTC TCATCTTTGG 2880

CCTGTTCAAT GAAACCATTG TTTGCCCATC TCTTCTTAGT GGAACTTTAG GTCTCTTTTC 2940

AAGTCTCCTC AGTCATCAAT AGTTCCTGGG GAAAAACAGA GCTGGTAGAC TTGAACAGGA 3000

GCATTGATGT TGGGTGGCTT TTGTTCTTTC ACTGAGAAAT TCGGAATACA TTTGTCTCAC 3060

CCCTGATATT GGTTCCTGAT GCCCCCCCAA CAAAAATAAA TAAATAAATT ATGGCTGCTT 3120

TATTTAAATA TAAGGTAGCT AGTTTTTACA CCTGAGATAA ATAATAAGCT TAGAGTGTAT 3180

TTTTCCCTTG CTTTTGGGGG TTCAGAGGAG TATGTACAAT TCTTCTGGGA AGCCAGCCTT 3240

CTGAACTTTT TGGTACTAAA TCCTTATTGG AACCAAGACA AAGGAAGCAA AATTGGTCTC 3300

TTTAGAGACC AATTTGCCTA AATTTTAAAA TCTTCCTACA CACATCTAGA CGTTCAAGTT 3360

TGCAAATCAG TTTTTAGCAA GAAAACATTT TTGCTATACA AACATTTTGC TAAGTCTGCC 3420

CAAAGCCCCC CCAATGCATT CCTTCAACAA AATACAATCT CTGTACTTTA AAGTTATTTT 3480

AGTCATGAAA TTTTATATGC AGAGAGAAAA AGTTACCGAG ACAGAAAACA AATCTAAGGG 3540

AAAGGAATAT TATGGGATTA AGCTGAGCAA GCAATTCTGG TGGAAAGTCA AACCTGTCAG 3600

TGCTCCACAC CAGGGCTGTG GTCCTCCCAG ACATGCATAG GAATGGCCAC AGGTTTACAC 3660

TGCCTTCCCA GCAATTATAA GCACACCAGA TTCAGGGAGA CTGACCACCA AGGGATAGTG 3720

TAAAAGGACA TTTTCTCAGT TGGGTCCATC AGCAGTTTTT CTTCCTGCAT TTATTGTTGA 3780

AAACTATTGT TTCATTTCTT CTTTTATAGG CCTTATTACT GCTTAATCCA AATGTGTACC 3840
```

TABLE 20-continued

```
ATTGGTGAGA CACATACAAT GCTCTGAATA CACTACGAAT TTGTATTAAA CACATCAGAA    3900

TATTTCCAAA TACAACATAG TATAGTCCTG AATATGTACT TTTAACACAA GAGAGACTAT    3960

TCAATAAAAA CTCACTGGGT CTTTCATGTC TTTAAGCTAA GTAAGTGTTC AGAAGGTTCT    4020

TTTTTATATT GTCCTCCACC TCCATCATTT TCAATAAAAG ATAGGGCTTT TGCTCCCTTG    4080

TTCTTGGAGG GACCATTATT ACATCTCTGA ACTACCTTTG TATCCAACAT GTTTTAAATC    4140

CTTAAATGAA TTGCTTTCTC CCAAAAAAAG CACAATATAA AGAAACACAA GATTTAATTA    4200

TTTTTCTACT TGGGGGGAAA AAAGTCCTCA TGTAGAAGCA CCCACTTTTG CAATGTTGTT    4260

CTAAGCTATC TATCTAACTC TCAGCCCATG ATAAAGTTCC TTAAGCTGGT GATTCCTAAT    4320

CAAGGACAAG CCACCCTAGT GTCTCATGTT TGTATTTGGT CCCAGTTGGG TACATTTTAA    4390

AATCCTGATT TTGGAGACTT AAAACCAGGT TAATGGCTAA GAATGGGTAA CATGACTCTT    4440

GTTGGATTGT TATTTTTTGT TTGCAATGGG GAATTTATAA GAAGCATCAA GTCTCTTTCT    4500

TACCAAAGTC TTGTTAGGTG GTTTATAGTT CTTTTGGCTA ACAAATCATT TTGGAAATAA    4560

AGATTTTTTA CTACAAAAAT G

SEQ ID NO: 6 Protein sequence
Protein Accession #: BAB18461
1         11         21         31         41         51
|         |          |          |          |          |
MRLSPAPLKL SRTPALLALA LPLAAALAFS DETLDKVPKS EGYCSRILRA QGTRREGYTE    60

FSLRVEGDPD FYKPGTSYRV TLSAAPPSYF RGFTLIALRE NREGDKEEDH AGTFQIIDEE    120

ETQFMSNCPV AVTESTPRRR TRIQVFWIAP PAGTGCVILK ASIVQKRIIY FQDEGSLTKK    180

LCEQDSTFDG VTDKPILDCC ACGTAKYRLT FYGNWSEKTH PKDYPRRANH WSAIIGGSHS    240

KNYVLWEYGG YASEGVKQVA ELGSPVKMEE EIRQQSDEVL TVIKAKAQWP AWQPLNVRAA    300

PSAEFSVDRT RHLMSFLTMM GPSPDWNVGL SAEDLCTKEC GWVQKVVQDL IPWDAGTDSG    360

VTYESPNKPT IPQERIRPLT SLDNPQSPFY DPEGGSITQV ARVVIERIAR KGEQCNIVPD    420

NVDDIVADLA PEEKDEDDTP ETCIYSNWSP WSACSSSTCD KGKRMRQRML KAQLDLSVPC    480

PDTQDFQPCM GPGCSDEDGS TCTNSEWITW SPCSISCGMG MRSRERYVKQ FPEDGSVCTL    540

PTEETEKCTV NEECSPSSCL MTEWGEWDEC SATCGMGMKK RHRMIKMNPA DGSMCKAETS    600

QAEKCMMPEC HTIPCLLSPW SEWSDCSVTC GKGMRTRQRM LKSLAELGDC NEDLEQVEKC    660

MLPECPIDCE LTEWSQWSEC NKSCGKGHVI RTRMIQMEPQ FGGAPCPETV QRKKCRIRKC    720

LRNPSIQKLR WREARESRRS EQLKEESEGE QFPGCRMRPN TAWSECTKLC GGGIQERYMT    780

VKKRFKSSQF TSCKDKKEIR ACNVHPC

SEQ ID NO: 7 DNA sequence
Nucleic Acid Accession #: NM_022454
Coding sequence: 205..1449
1         11         21         31         41         51
|         |          |          |          |          |
GCAGTGTCAC TAGGCCGGCT GGGGGCCCTG GGTACGCTGT AGACCAGACC GCGACAGGCC    60

AGAACACGGG CGGCGGCTTC GGGCCGGGAG ACCCGCGCAG CCCTCGGGGC ATCTCAGTGC    120

CTCATTCCCC ACCCCCTCCC CCGGGTCGGG GGAGGCGGCG CGTCCGGCGG AGGGTTGAGG    180

GGAGCGGGGC AGGCCTGGAG CGCCATGAGC AGCCCGGATG CGGGATACGC CAGTGACGAC    240

CAGAGCCAGA CCCAGAGCGC GCTGCCCGCG GTGATGGCCG GCTGGGCCC CTGCCCCTGG    300

GCCGAGTCGC TGAGCCCCAT CGGGGACATG AAGGTGAAGG CGAGGCGCC GGCGAACAGC    360

GGAGCACCGG CCGGGCCGC GGGCCGAGCC AAGGGCGAGT CCCGTATCCG GCGGCCGATG    420

AACGCTTTCA TGGTGTGGGC TAAGGACGAG CGCAAGCGGC TGGCGCAGCA GAATCCAGAC    480
```

TABLE 20-continued

```
CTGCACAACG CCGAGTTGAG CAAGATGCTG GGCAAGTCGT GGAAGGCGCT GACGCTGGCG    540

GAGAAGCGGC CCTTCGTGGA GGAGGCAGAG CGGCTGCGCG TGCAGCACAT GCAGGACCAC    600

CCCAACTACA AGTACCGGCC GCGGCGGCGC AAGCAGGTGA AGCGGCTGAA GCGGGTGGAG    660

GGCGGCTTCC TGCACGGCCT GGCTGAGCCG CAGGCGGCCG CGCTGGGCCC CGAGGGCGGC    720

CGCGTGGCCA TGGACGGCCT GGGCCTCCAG TTCCCCGAGC AGGGCTTCCC CGCCGGCCCG    780

CCGCTGCTGC CTCCGCACAT GGGCGGCCAC TACCGCGACT GCCAGAGTCT GGGCGCGCCT    840

CCGCTCGACG GCTACCCGTT GCCCACGCCC GACACGTCCC CGCTGGACGG CGTGGACCCC    900

GACCCGGCTT TCTTCGCCGC CCCGATGCCC GGGGACTGCC CGGCGGCCGG CACCTACAGC    960

TACGCGCAGG TCTCGGACTA CGCTGGCCCC CCGGAGCCTC CCGCCGGTCC CATGCACCCC   1020

CGACTCGGCC CAGAGCCCGC GGGTCCCTCG ATTCCGGGCC TCCTGGCGCC ACCCAGCGCC   1080

CTTCACGTGT ACTACGGCGC GATGGGCTCG CCCGGGCGG GCGGCGGGCG CGGCTTCCAG    1140

ATGCAGCCGC AACACCAGCA CCAGCACCAG CACCAGCACC ACCCCCCGGG CCCCGGACAG   1200

CCGTCGCCCC CTCCGGAGGC ACTGCCCTGC CGGGACGGCA CGGACCCCAG TCAGCCCGCC   1260

GAGCTCCTCG GGGAGGTGGA CCGCACGGAA TTTGAACAGT ATCTGCACTT CGTGTGCAAG   1320

CCTGAGATGG GCCTCCCCTA CCAGGGGCAT GACTCCGGTG TGAATCTCCC CGACAGCCAC   1380

GGGGCCATTT CCTCGGTGGT GTCCGACGCC AGCTCCGCGG TATATTACTG CAACTATCCT   1440

GACGTGTGAC AGGTCCCTGA TCCGCCCCAG CCTGCAGGCC AGAAGCAGTG TTACACACTT   1500

CCTGGAGGAG CTAAGGAAAT CCTCAGACTC CTGGGTTTTT GTTGTTGCTG TTGTTGTTTT   1560

TTAAAAGGTG TGTTGGCATA TAATTTATGG TAATTTATTT TGTCTGCCAC TTGAACAGTT   1620

TGGGGGGGTG AGGTTTCATT TAAAATTTGT TCAGAGATTT GTTTCCCACA GTTGGATTGT   1680

CAAAACCCTA TTTCCAAGTT CAAGTTAACT AGCTTTGAAT GTGTCCCAAA ACAGCTTCCT   1740

CCATTTCCTG AAAGTTTATT GATCAAAGAA ATGTTGTCCT GGGTGTGTTT TTTCAATCTT   1800

CTAAAAAATA AAATCTGGAA TCCTGAAAAA AAAAAAAAA AAAAAAAAA AAA

SEQ ID NO: 8 Protein sequence
Protein Accession #: NP_071899
1          11         21         31         41         51
|          |          |          |          |          |
MSSPDAGYAS DDQSQTQSAL PAVMAGLGPC PWAESLSPIG DMRVKGEAPA NSGAPAGAAG     60

RAKGESRIRR PMNAFMTWAK DERKRLAQQN PDLHNAELSK MLGKSWKALT LAEKRPFVEE   120

AERLRVQHMQ DHPNYKYRPR RRKQVKRLKR VEGGFLHGLA EPQAAALGPE GGRVANDGLG   180

LQFPEQGFPA GPPLLPPHMG GHYRDCQSLG APPLDGYPLP TPDTSPLDGV DPDPAFFAAP   240

MPGDCPAAGT YSYAQVSDYA GPPEPPAGPM HPRLGPEPAG PSIPGLLAPP SALHVYYGAM   300

GSPGAGGGRG FQMQPQHQHQ HQHQHHPPGP GQPSPPPEAL PCRDGTDPSQ PAELLGEVDR   360

TEFEQYLHFV CKPEMGLPYQ GHDSGVNLPD SHGAISSVVS DASSAVYYCN YPDV

SEQ ID NO. 9 DNA sequence
Nucleic Acid Accession #: NM_018098
Coding sequence: 112..2856
1          11         21         31         41         51
|          |          |          |          |          |
AAGCTTGCGG CCGCCGGCGA GGAATGGCGG TATTTGTGAG AGGAGTCGGC GTTTGAAGAG     60

GTGGAACTCC TAGGGCTTTT TTGAGAGTGC TGATTTAGAA GAATACAAAT CATGGCTGAA    120

AATAGTGTAT TAACATCCAC TACTGGGAGG ACTAGCTTGG CAGACTCTTC CATTTTTGAT    180

TCTAAAGTTA CTGAGATTTC CAAGGAAAAC TTACTTATTG GATCTACTTC ATATGTAGAA    240

GAAGAGATGC CTCAGATTGA AACAAGAGTG ATATTGGTTC AAGAAGCTGG AAAACAAGAA    300
```

TABLE 20-continued

```
GAACTTATAA AAGCCTTAAA GACTATTAAA ATAATGGAAG TCCCTGTTAT AAAGATAAAA  360
GAAAGTTGTC CTGGAAAATC GGATGARAAA TTAATAAAAA GTGTTATTAA TATGGACATT  420
AAAGTGGGCT CTGTAAAGAT GGAGTCAGTG GAAGAATTTG AAGGTTTGGA TTCTYCGGAA  480
TTKGAAAATG TATTTKKAGK CACGGACTTT CAGGATTCTG TCTTTAATGA CCTCTACAAG  540
GCTGATTGTA GAGTTATTGG ACCACCAGTT GTATTAAATT GTTCACAAAA AGGAGAGCCT  600
TTGCCATTTT CATGTCGCCC GTTGTATTGT ACAAGTATGA TGAATCTAGT ACTATGCTTT  660
ACTGGATTTA GGAAAAAAGA AGAACTAGTC AGGTTGGTGA CATTGGTCCA TCACATGGGT  720
GGAGTTATTC GAAAAGACTT TAATTCAAAA GTTACACATT TGGTGGCAAA TTGTACACAA  780
GGAGAAAAAT TCAGGGTTGC TGTGAGTCTA GGTACTCCAA TTATGAAGCC AGAATGGATT  840
TATAAAGCTT GGGAAAGGCG GAATGAACAG GATTTCTATG CAGCAGTTGA TGACTTTAGA  900
AATGAATTTA AAGTTCCTCC ATTTCAAGAT TGTATTTTAA GTTTCCTGGG ATTTTCAGAT  960
GAAGAGAAAA CCAATATGGA AGAAATGACT GAAATGCAAG GAGGTAAATA TTTACCGCTT 1020
GGAGATGAAA GATGCACTCA CCTTGTAGTT GAAGAGAATA TAGTAAAAGA TCTTCCCTTT 1080
GAACCTTCAA AGAAACTTTA TGTTGTCAAG CAAGAGTGGT TCTGGGGAAG CATTCAAATG 1140
GATGCCCGAG CTGGAGAAAC TATGTATTTA TATGAAAAGG CAAATACTCC TGAGCTCAAG 1200
AAATCAGTGT CAATGCTTTC TCTAAATACC CCTAACAGCA ATCGCAAACG ACGTCGTTTA 1260
AAAGAAACAC TTGCTCAGCT TTCAAGAGAG ACAGACGTGT CACCATTTCC ACCCCGTAAG 1320
CGCCCATCAG CTGAGCATTC CCTTTCCATA GGGTCACTCC TAGATATCTC CAACACACCA 1380
GAGTCTAGCA TTAACTATGG AGACACCCCA AAGTCTTGTA CTAAGTCTTC TAAAAGCTCC 1440
ACTCCAGTTC CTTCAAAGCA GTCAGCAAGG TGGCAAGTTG CAAAAGAGCT TTATCAAACT 1500
GAAAGTAATT ATGTTAATAT ATTGGCAACA ATTATTCAGT TATTTCAAGT ACCATTGGAA 1560
GAGGAAGGAC AACGTGGTGG ACCTATCCTT GCACCAGAGG AGATTAAGAC TATTTTTGGT 1620
AGCATCCCAG ATATCTTTGA TGTACACACT AAGATAAAGG ATGATCTTGA AGACCTTATA 1680
GTTAATTGGG ATGAGAGCAA AAGCATTGGT GACATTTTTC TGAAATATTC AAAAGATTTG 1740
GTAAAAACCT ACCCTCCCTT TGTAAACTTC TTTGAAATGA GCAAGGAAAC AATTATTAAA 1800
TGTGAAAAAC AGAAACCAAG ATTTCATGCT TTTCTCAAGA TAAACCAAGC AAAACCAGAA 1860
TGTGGACGGC AGAGCCTTGT TGAACTTCTT ATCCGACCAG TACAGAGGTT ACCCAGTGTT 1920
GCATTACTTT TAAATGATCT TAAGAAGCAT ACAGCTGATG AAAATCCAGA CAAAAGCACT 1980
TTAGAAAAAG CTATTGGATC ACTGAAGGAA GTAATGACGC ATATTAATGA GGATAAGAGA 2040
AAAACAGAAG CTCAAAAGCA AATTTTTGAT GTTGTTTATG AAGTAGATGG ATGCCCAGCT 2100
AATCTTTTAT CTTCTCACCG AAGCTTAGTA CAGCGGGTTG AAACAATTTC TCTAGGTGAG 2160
CACCCCTGTG ACAGAGGAGA ACAAGTAACT CTCTTCCTCT TCAATGATTG CCTAGAGATA 2220
GCAAGAAAAC GGCACAAGGT TATTGGCACT TTTAGGAGTC CTCATGGCCA AACCCGACCC 2280
CCAGCTTCTC TTAAGCATAT TCACCTAATG CCTCTTTCTC AGATTAAGAA GGTATTGGAC 2340
ATAAGAGAGA CAGAAGATTG CCATAATGCT TTTGCCTTGC TTGTGAGGCC ACCAACAGAG 2400
CAGGCAAATG TGCTACTCAG TTTCCAGATG ACATCAGATG AACTTCCAAA AGAAACTGG  2460
CTAAAGATGC TGTGTCGACA TGTAGCTAAC ACCATTTGTA AAGCAGATGC TGAGAATCTT 2520
ATTTATACTG CTGATCCAGA ATCCTTTGAA GTAAATACAA AAGATATGGA CAGTACATTG 2580
AGTAGAGCAT CAAGAGCAAT AAAAAAGACT TCAAAAAAGG TTACAAGAGC ATTCTCTTTC 2640
TCCAAAACTC CAAAAAGAGC TCTTCGAAGG GCTCTTATGA CATCCCACGG CTCAGTGGAG 2700
```

TABLE 20-continued

```
GGAAGAAGTC CTTCCAGCAA TGATAAGCAT GTAATGAGTC GTCTTTCTAG CACATCATCA 2760

TTAGCAGGTA TCCCTTCTCC CTCCCTTGTC AGCCTTCCTT CCTTCTTTGA AAGGAGAAGT 2820

CATACGTTAA GTAGATCTAC AACTCATTTG ATATGAAGCG TTACCAAAAT CTTAAATTAT 2880

AGAAATGTAT AGACACCTCA TACTCAAATA AGAAACTGAC TTAAATGGTA CTTGTAATTA 2940

GCACTTGGTG AAAGCTGGAA GGAAGATAAA TAACACTAAA CTATGCTATT TGATTTTTCT 3000

TCTTGAAAGA GTAAGGTTTA CCTGTTACAT TTTCAAGTTA ATTCATGTAA AAAATGATAG 3060

TGATTTTGAT GTAATTTATC TCTTGTTTGA ATCTGTCATT CAAAGGCCAA TAATTTAAGT 3120

TGCTATCAGC TGATATTAGT AGCTTTGCAA CCCTGATAGA GTAAATAAAT TTTATGGGCG 3180

GGTGCCAAAT ACTGCTGTGA ATCTATTTGT ATAGTATCCA TGAATGAATT TATGGAAATA 3240

GATATTTGTG CAGCTCAATT TATGCAGAGA TTAAATGACA TCATAATACT GGATGAAAAC 3300

TTGCATAGAA TTCTGATTAA ATAGTGGGTC TGTTTCACAT GTGCAGTTTG AAGTATTTAA 3360

ATAACCACTC CTTTCACAGT TTATTTTCTT CTCAAGCGTT TTCAAGATCT AGCATGTGGA 3420

TTTTAAAAGA TTTGCCCTCA TTAACAAGAA TAACATTTAA AGGAGATTGT TTCAAAATAT 3480

TTTTGCAAAT TGAGATAAGG ACAGAAAGAT TGAGAAACAT TGTATATTTT GCAAAAACAA 3540

GATGTTTGTA GCTGTTTCAG AGAGAGTACG GTATATTTAT GGTAATTTTA TCCACTAGCA 3600

AATCTTGATT TAGTTTGATA GTGTGTGGAA TTTTATTTTG AAGGATAAGA CCATGGGAAA 3660

ATTGTGGTAA AGACTGTTTG TACCCTTCAT GAAATAATTC TGAAGTTGCC ATCAGTTTTA 3720

CTAATCTTCT GTGAAATGCA TAGATATGCG CATGTTCAAC TTTTTATTGT GGTCTTATAA 3780

TTAAATGTAA AATTGAAAAT TCATTTGCTG TTTCAAAGTG TGATATCTTT CACAATAGCC 3840

TTTTTATAGT CAGTAATTCA GAATAATCAA GTTCATATGG ATAAATGCAT TTTTATTTCC 3900

TATTTCTTTA GGGAGTGCTA CAAATGTTTG TCACTTAAAT TTCAAGTTTC TGTTTTAATA 3960

GTTAACTGAC TATAGATTGT TTTCTATGCC ATGTATGTGC CACTTCTGAG AGTAGTAAAT 4020

GACTCTTTGC TACATTTTAA AAGCAATTGT ATTAGTAAGA ACTTTGTAAA TAAATACCTA 4080

AAACCCAAAA AAAAAAAAAA AAAAA
```

SEQ ID NO: 10 Protein sequence
Protein Accession #: Q9H8V3

```
1          11         21         31         41         51
|          |          |          |          |          |
MAENSVLTST TGRTSLADSS IFDSKVTEIS KENLLIGSTS YVEEEMPQIE TRVILVQEAG  60

KQEELTKALK DIKVGFVKME SVEEFEGLDS PEFSNVFVVT DFQDSVFNDL YKADCRVIGP 120

PVVLNCSQKG EPLPFSCRPL YCTSMMNLVL CFTGFRKKEE LVRLVTLVHH MGGVIRKDFN 180

SKVTHLVANC TQGEKFRVAV SLGTPIMKPE WIYKAWERRN EQDFYAAVDD FRNEFKVPPF 240

QDCIFSFLGF SDEEKTNMEE MTEMQGGKYL PLGDERCTHL VVEENIVKDL PFEPSKKLYV 300

VKQEWFWGSI QMDARAGETM YLYEKANTPE LKKSVSMLSL NTPNSNRKRR RLKETLAQLS 360

RDTDVSPFPP RKRPSAEHSL SIGSLLDISN TPESSINYGD TPKSCTKSSK SSTPVPSKQS 420

ARWQVAKELY QTESNYVNIL ATIIQLFQVP LEEEGQRGGP ILAPEEIKTI FGSIPDIFDV 480

HTKIKDDLED LIVNWDESKS IGDIFLKYSK DLVKTYPPFV NFFEMSKETI IKCEKQKPRF 540

HAFLKINQAK PECGRQSLVE LLIRPVQRLP SVALLLNDLK KHTADENPDK STLEKAIGSL 600

KEVMTHINED KRKTEAQKQI FDVVYEVDGC PANLLSSHRS LVQRVETISL GEHPCDRGEQ 660

VTLFLFNDCL EIARKRHEVI GTFRSPHGQT RPPASLKHIH LMPLSQIKKV LDIRETEDCH 720

NAFALLVRPP TEQANVLLSF QMTSDELPKE NWLKMLCRHV ANTICKADAE NLIYTADPES 780
```

TABLE 20-continued

FEVNTKDMDS TLSRASRAIK KTSKKVTRAF SFSKTPKRAL RRALMTSHGS VEGRSPSSND 840

KHVMSRLSST SSLAGIPSPS LVSLPSFFER RSHTLSRSTT HLI

SEQ ID NO: 11 DNA sequence
Nucleic Acid Accession #: XM_044166
Coding sequence: 1..1576

```
1          11         21         31         41         51
|          |          |          |          |          |
CTTTTGTTTC GCCATGCCTA GTCTAGTGGT ATCTGGAATA ATGGAAAGAA ATGGGGCTT   60
TGGAGAACTA GGATGTTTCG GGGGAAGCGC TAAGGACCGA GGGCTGCTGG AACACGAGCG  120
CGCCCTTCAG CTGGCTCTCG ATCAACTCTG CCTCCTGGGT TTGGGGGAGC CCCCCGCCCC  180
CAGGGCGGGC CAGGACGGGG GAGGTGGGGG GGGCGGCGCC CCCGCGCAGC CGACAGCCCC  240
CCCGCAGCCG CGCCGCCGC CGCCGCCCGC GGCGCCCCCG CCGCCCCGA CGACGGCCCC   300
CGCAGCGCAG ACGCCCCAGC CCCCCACCGC CCCCAAAGGG GCGAGCGACG CCAAGCTCTG  360
CGCTCTCTAC AAAGAGGCCG AGCTGCGCCT GAAGGGCAGC AGCAACACCA CGGAGTGTGT  420
TCCCGTGCCC ACCTCCGAGC ACGTGGCCGA GATCGTGGGC AGGCAAGGCT GCAAGATTAA  480
GGCCTTGAGG GCCAAGACCA ACACCTACAT CAAGACACCG GTGAGGGGCG AGGAACCAGT  540
GTTCATGGTG ACAGGGCGAC GGGAGGACGT GGCCACAGCC CGGCGGGAAA TCATCTCAGC  600
AGCGGAGCAC TTCTCCATGA TCCGTCCCTC CCGCAACAAG TCAGGCGCCG CCTTTGGTGT  660
GGCTCCTGCT CTGCCCGGCC AGGTGACCAT CCGTGTGCGG GTGCCCTACC GCGTGGTGGG  720
GCTGGTGGTG GGCCCCAAAG GGCAACCAAG CGCATC CAGCAGCAAA CCAACACATA       780
CATTATCACA CCAAGCCGTG ACCGCGACCC CGTGTTCGAG ATCACGGGTG CCCCAGGCAA  840
CGTGGAGCGT GCGCGCGAGG AGATCGACAC GCACATCGCG GTGCGCACTG GCAAGATCCT  900
CGAGTACAAC AATGAAAACG ACTTCCTGGC GGGGAGCCCC GACGCAGCAA TCGATAGCCG  960
CTACTCCGAC GCCTGGCGGG TGCACCAGCC CGGCTGCAAG CCCCTCTCCA CCTTCCGGCA 1020
GAACAGCCTG GGCTGCATCG GCGAGTGCGG AGTGGACTCT GGCTTTGAGG CCCCACGCCT 1080
GGGTGAGCAG GGCGGGGACT TTGGCTACGG CGGGTACCTC TTTCCGGGCT ATGGCGTGGG 1140
CAAGCAGGAT GTGTACTACG GCGTGGCCGA GACTAGCCCC CCGCTGTGGG CGGGCCAGGA 1200
GAACGCCACG CCCACCTCCG TGCTCTTCTC CTCTGCCTCC TCCTCCTCCT CCTCTTCCGC 1280
CAAGGCCCGC GCTGGGCCCC CGGGCGCACA CCGCTCCCCT GCCACTTCCG CGGGACCCGA 1320
GCTGGCCGGA CTCCCGAGGC GCCCCCCGGG AGAGCCGCTC CAGGGCTTCT CTAAACTTGG 1380
TGGGGGCGGC CTGCGGAGCC CCGGCGGCGG GCGGGATTGC ATGGTCTGCT TTGAGAGCGA 1440
AGTGACTGCC GCCCTTGTGC CCTGCGGACA CAACCTGTTC TGCATGGAGT GTGCAGTACG 1500
CATCTGCGAG AGGACGGACC CAGAGTGTCC CGTCTGCCAC ATCACAGCCA CGCAAGCCAT 1560
CCGAATATTC TCCTAAGCCC CGTGCCCCAT GCCTCCGGGG CCCACTCCAC TGGGCCCACC 1620
CTGGACCTGT TTTCCACTAA AGCCTTTTGG AAAGCGGTGA TTTGAGGGGC AAGGTGCTTA 1680
GAGATACTCG CTCGCTGGGG AAGGGGGGAG GGAGGCAGTG GTGGCTGGAG GGTGCGCCAC 1740
TTTCAGAGCC TCTGGTCACC CTGTCCTGGA AGATTGGGA GGGGGCCAGA CTGAAAATTT  1800
TACTAGAGTT ACAACTCTGA TACCTCAACA CACCCTTAAA TCTGGAAGCA GCTAAGAGAA 1860
ACTTTTGTTT TGCCAGAGGT GGCCACTAAG GCATTCTGAC GCCCTCTGCC CACCTCCCCC 1920
GCTGTGTGTC ACTCCACCCC TTCTTCCGAG GAGGGGTGG GTAAAAGGGA GAGGGAGAAT  1980
TACCACCTGT ATCTAGAGGT GCTCTTTGCA ATCCCTAAGC CCTCTGGTCC TGACCTCCGA 2040
CCTCCCAGCT CTGTCTTGTT CCTTGTCTTT GTCTTTCTTC CCTTCCCCCT GCCCCTGCCC 2100
```

TABLE 20-continued

```
CTACCAGCCC AGCTTTGGGG ACACCATCCT TCTGGGGAGA AGTAGGGGGA GGAATATTTG  2160
GATGGTCCCT CCATTCCTCT TCAGGCATCT GGAGGCCCTC TCCCCCACTC CTCCAAAGAA  2220
ACATCTCAAA TTATTGATGG AATGTATCCC CATTCTCAGT GAAAATGTGA GGAGGGGACT  2280
AATACTGGGG TAAAGGGTCA AACCCCCACC TTCATCACTA TGGGCATTAT ATTTAGGGAG  2340
TAGTTCTTGG GCTGGATTTT CTGGTTGTGG AAGTGGGGGC GCCAGAGTAG TGTGTCTGCT  2400
ATTTAAAGGA GCAGGAAAGG GCGTGAGGCA GGAGGAGAGA CTGGTGGAGG GAAGAGCTGC  2460
TCCTCCCATG CAGTGCCCGA CTCCCTGCAC CCCTCTCAAC CTGACCTGAA CCTTTATTGA  2520
ATCCTTATTA GCTTGAATCC TTATTAGCTT GAATCCTCCA TGCAAATCAT GGAGTCTGTG  2580
TCCCACCTGA TGTGGTTGAG GAGAAGCCAG GTCTTCAAAG AGGGGTCAGC CTGGGGCAAA  2640
GCAGGACTGG GGGGAGGTGG GCAGCAGGGC CTATTCTGAG AATCACATAT TGTTACAGGC  2700
CTTGCACCCC CTTTGCTGCT TCCCTCCTGC TCATTTGGGG CTGCCACCAG CTCTCCACCC  2760
TCCTGGTTCC GCTGGCCGGG CCAAGAGAGG ATGGAGGGAT GGGAGTCCCA GGAGATCCTT  2820
GTAAATAGTG GGGTGGGACT GTTCTGAGTG ATCACCCGAG CACTTAAAGC TCCAGAGTCC  2880
CATTCTTCCT GGATGGAGCA GGTGGAGGTG CAGAGGGGAT TTCCTCCTCT CCTTCCTCCT  2940
GTCGAGAATT AACACCTCTC CACAGCCTTC CCCTCCAGAA CACCAGCCAG GGAGGGGTGG  3000
GGAAGGAGGT CACAGCCAAG AAAACTGCCC TGTGACGACT TCCCTCCTTC CCGCCTATGT  3060
GAGCCATCCT GAGATGTCTG TACAATAGAA ACCAAACCAA ATGGGCACCC TCGGTTGCCG  3120
GGGGGCAGGT GGGGAGGGGG GTGGGAAGAA GGGATGTCTG TCTGTCGTCC CCCTCCCCCT  3180
CTCCACTCTT TACCCACAAA GGCAGAAGAC TGTTACACTA GGGGGCTCAG CAAATTCAAT  3240
CCCACCCTTA CCAATTGAGC CAAACCTAGA ACAAACACA AAAACACGAAT AGTGAGAGAC  3300
AAAATAGAGG AGAGAAAGAG AGCATGAGAG GGAGCGAGAC AGGCGACCAA CACAGAGGAG  3360
AGAAAACAAA AATAGCAAAA AAAAAAAAAA AAAGCAGTTC TTTATAATTT AATATTCTAT  3420
TTTAATAAAG GCGTTTATTA CCATATAAAT GTAGCAAAGA ACCTGGGCTA ATATGAA

SEQ ID NO: 12 Protein sequence
Protein Accession #: XP_044166
1          11         21         31         41         51
|          |          |          |          |          |
FCFANPSLVV SGIMERNGGF GELGCPGGSA KDRGLLEDER ALQLALDQLC LLGLGEPPAP  60

RAGEDGGGGG GGAPAQPTAP PQPAPPPPPA APPAAPTTAP AAQTPQPPTA PKGASDAKLC  120

ALYKEAELRL KGSSNTTECV PVPTSENVAE IVGRQGCKIK ALRAKTNTYI KTPVRGEEPV  180

FMVTGRREDV ATARREIISA AEHFSMIRAS RNKSGAAFGV APALPGQVTI RVRVPYRVVG  240

LVVGPKGATI KRIQQQTNTY IITPSRDRDP VFEITGAPGN VERAREEIET HIAVRTGKIL  300

EYNNENDFLA GSPDAAIDSR YSDAWRVHQP GCKPLSTFRQ NSLGCIGECG VDSGFEAPEL  360

GEQGGDFGYG GYLFPGYGVG KQDVYYGVAE TSPPLWAGQE NATPTSVLFS SASSSSSSSA  420

KARAGPPGAH RSPATSAGPE LAGLPRRPPG EPLQGFSKLG GGGLRSPGGG RDCNVCFESE  480

VTAALVPCGN NLFCMECAVR ICERTDPECP VCHITATQAI RIFS

SEQ ID NO: 13 DNA sequence
Nucleic Acid Accession #: Eos sequence
Coding sequence: 1..2982
1          11         21         31         41         51
|          |          |          |          |          |
ATGGTTTTCT CTGTCAGGCA GTGTGGCCAT GTTGGCAGAA CTGAAGAAGT TTTACTGACG  60

TTCAAGTATA TCCTTGTCAT CATTTGTCTT CATGTCGTTC TGGTAACATC CCTGGAAGAA  120

GATACTGATA ATTCCAGTTT GTCACCACCA CCTGATGTTA CTTTAAGCTT ACTCCCTTCA  180
```

TABLE 20-continued

```
AACGAAACAG AAAAAACTAA AATCACTATA GTAAAAACCT TCAATGCTTC AGGCGTCAAA  240

CCCCAGAGAA ATATCTGCAA TTTGTCATCT ATTTGCAATG ACTCAGCATT TTTTAGAGGT  300

GAGATCATGT TTCAATATGA TAAAGAAAGC ACTGTTCCCC AGAATCAACA TATAACGAAT  360

GGCACCTTAA CTGGAGTCCT GTCTCTAAGT GAATTAAAAC GCTCAGAGCT CAACAAAACC  420

CTGCAAACCC TAAGTGAGAC TTACTTTATA ATGTGTGCTA CAGCAGAGGC CCAAAGCACA  480

TTAAATTGTA CATTCACAAT AAAACTGAAT AATACAATGA ATGCATGTGC TGTAATAGCT  540

GCTTTGGAAA GAGTAAAGAT TCGACCAATG GAACACTGCT GCTGTTCTGT CAGGATACCC  600

TGCCCTTCCT CCCCAGAAGA GTTGGAAAAG CTTCAGTGTG ACCTGCAGGA TCCCATTGTC  660

TGTCTTGCTG ACCATCCACG TGGCCCACCA TTTTCTTCCA GCCAATCCAT CCCAGTGGTG  720

CCTCGGGCCA CTGTGCTTTC CCAGGTCCCC AAAGCTACCT CTTTTGCTGA GCCTCCAGAT  780

TATTCACCTG TGACCCACAA TGTTCCCTCT CCAATAGGGG AGATTCAACC CCTTTCACCC  840

CAGCCTTCAG CTCCCATAGC TTCCAGCCCT GCCATTGACA TGCCCCCACA GTCTGAAACG  900

ATCTCTTCCC CTATGCCCCA AACCCATGTC TCCGGCACCC CACCTCCTGT GAAAGCCTCA  960

TTTTCCTCTC CCACCGTGTC TGCCCCTGCG AATGTCAACA CTACCAGCGC ACCTCCTGTC 1020

CAGACAGACA TCGTCAACAC CAGCAGTATT TCTGATCTTG AGAACCAAGT GTTGCAGATG 1080

GAGAAGGCTC TGTCCTTGGG CAGCCTGGAG CCTAACCTCG CAGGAGAAAT GATCAACCAA 1140

GTCAGCAGAC TCCTTCATTC CCCGCCTGAC ATGCTGGCCC CTCTGGCTCA AGATTGCTG  1200

AAAGTAGTGG ATGACATTGG CCTACAGCTG AACTTTTCAA ACACGACTAT AAGTCTAACC 1260

TCCCCTTCTT TGGCTCTGGC TGTGATCAGA GTGAATGCCA GTAGTTTCAA CACAACTACC 1320

TTTGTGGCCC AAGACCCTGC AAATCTTCAG GTTTCTCTGG AAACCCAAGC TCCTGAGAAC 1380

AGTATTGGCA CAATTACTCT TCCTTCATCG CTGATGAATA ATTTACCAGC TCATGACATG 1440

GAGCTAGCTT CCAGGGTTCA GTTCAATTTT TTTGAAACAC CTGCTTTGTT TCAGGATCCT 1500

TCCCTGGAGA ACCTCTCTCT GATCAGCTAC GTCATATCAT CGAGTGTTGC AAACCTGACC 1560

GTCAGGAACT TGACAAGAAA CGTGACAGTC ACATTAAAGC ACATCAACCC GAGCCAGGAT 1620

GAGTTAACAG TGAGATGTGT ATTTTGGGAC TTGGGCAGAA ATGGTGGCAG AGGAGGCTGG 1680

TCAGACAATG GCTGCTCTGT CAAAGACAGG AGATTGAATG AAACCATCTG TACCTGTAGC 1740

CATCTAACAA GCTTCGGCGT TCTGCTGGAC CTATCTAGGA CATCTGTGCT GCCTGCTCAA 1800

ATGATGGCTC TGACGTTCAT TACATATATT GGTTGTGGGC TTTCATCAAT TTTTCTGTCA 1860

GTGACTCTTG TAACCTACAT AGCTTTTGAA AAGATCCGGA GGGATTACCC TTCCAAAATC 1920

CTCATCCAGC TGTGTGCTGC TCTGCTTCTG CTGAACCTGG TCTTCCTCCT GGACTCGTGG 1960

ATTGCTCTGT ATAAGATGCA AGGCCTCTGC ATCTCAGTGG CTGTATTTCT TCATTATTTT 2040

CTCTTGGTCT CATTCACATG GATGGGCCTA GAAGCATTCC ATATGTACCT GGCCCTTGTC 2100

AAAGTATTTA ATACTTACAT CCGAAAATAC ATCCTTAAAT TCTGCATTGT CGGTTGGGGG 2160

GTACCAGCTG TGGTTGTGAC CATCATCCTG ACTATATCCC CAGATAACTA TGGGCTTGGA 2220

TCCTATGGGA AATTCCCCAA TGGTTCACCG GATGACTTCT GCTGGATCAA CAACAATGCA 2280

GTATTCTACA TTACGGTGGT GGGATATTTC TGTGTGATAT TTTTGCTGAA CGTCAGCATG 2340

TTCATTGTGG TCCTGGTTCA GCTCTGTCGA ATTAAAAAGA AGAAGCAACT GGGAGCCCAG 2400

CGAAAAACCA GTATTCAAGA CCTCAGGAGT ATCGCTGGCC TTACATTTTT ACTGGGAATA 2460

ACTTGGGGCT TGCCTTCTT TGCCTGGGGA CCAGTTAACG TGACCTTCAT GTATCTGTTT 2520

GCCATCTTTA ATACCTTACA AGGATTTTTC ATATTCATCT TTTACTGTGT GGCCAAAGAA 2580
```

TABLE 20-continued

```
AATGTCAGGA AGCAATGGAG GCGGTATCTT TGTTGTGGAA AGTTACGGCT GGCTGAAAAT 2640

TCTGACTGGA GTAAAACTGC TACTAATGGT TTAAAGAAGC AGACTGTAAA CCAAGGAGTG 2700

TCCAGCTCTT CAAATTCCTT ACAGTCAAGC AGTAACTCCA CTAACTCCAC CACACTGCTA 2760

GTGAATAATG ATTGCTCAGT ACACGCAAGC GGGAATGGAA ATGCTTCTAC AGAGAGGAAT 2820

GGGGTCTCTT TTAGTGTTCA GAATGGAGAT GTGTGCCTTC ACGATTTCAC TGGAAAACAG 2880

CACATGTTTA ACGAGAAGGA AGATTCCTGC AATGGGAAAG GCCGTATGGC TCTCAGAAGG 2940

ACTTCAAAGC GGGGAAGCTT ACACTTTATT GAGCAAATGT GA

SEQ ID NO: 14 Protein sequence
Protein Accession #: Eos sequence
1          11         21         31         41         51
|          |          |          |          |          |
MVFSVRQCGN VGRTEEVLLT FKIFLVIICL NVVLVTSLEE DTDNSSLSPP PDVTLSLLPS  60

NETEKTKITI VETFNASGVK PQRNICNLSS ICNDSAFFRG EIMFQYDKES TVPQNQHITN 120

GTLTGVLSLS ELKRSELNKT LQTLSETYFI MCATAEAQST LNCTFTIKLN NTMNACAVIA 180

ALERVKIRPM EHCCCSVRIP CPSSPEELEK LQCDLQDPIV CLADHPRGPP FSSSQSIPVV 240

PRATVLSQVP KATSFAEPPD YSPVTHNVPS PIGEIQPLSP QPSAPIASSP AIDMPPQSET 300

ISSPMPQTHV SGTPPPVKAS FSSPTVSAPA NVNTTSAPPV QTDIVNTSSI SDLENQVLQM 360

EKALSLGSLE PNLAGEMINQ VSRLLHSPPD MLAPLAQRLL KVVDDIGLQL NFSNTTISLT 420

SPSLALAVIR VNASSFNTTT FVAQDPANLQ VSLETQAPEN SIGTITLPSS LMNNLPANDM 480

ELASRVQFNF FETPALFQDP SLENLSLISY VISSSVANLT VRNLTRNVTV TLKHINPSQD 540

ELTVRCVFWD LGRNGGRGGW SDNGCSVKDR RLNETICTCS NLTSFGVLLD LSRTSVLPAQ 600

MMALTFITYI GCGLSSIFLS VTLVTYIAFE KIRRDYPSKI LIQLCAALLL LNLVFLLDSW 660

IALYKNQGLC ISVAVFLNYF LLVSFTWMGL EAFHMYLALV KVFNTYIRKY ILKFCIVGWG 720

VPAVVVTIIL TISPDNYGLG SYGKFPNGSP DDFCWINNNA VFYITVVGYF CVIFLLNVSN 780

FIVVLVQLCR IKKKKQLGAQ RKTSIQDLRS IAGLTFLLGI TWGFAFFAWG PVNVTFMYLF 840

AIFNTLQGFF IFIFYCVAKE NVRKQWRRYL CCGKLRLAEN SDWSKTATNG LKKQTVNQGV 900

SSSSNELQSS SNSTNSTTLL VNNDCSVHAS GNGNASTERN GVSFSVQNGD VCLHDFTGKQ 960

HMFNEKEDSC NGKGRMALRR TSKRGSLHFI EQM

SEQ ID NO: 15 DNA sequence
Nucleic Acid Accession #: Eos sequence
Coding sequence: 1..2904
1          11         21         31         41         51
|          |          |          |          |          |
ATGGTTTTCT CTGTCAGGCA GTGTGGCCAT GTTGGCAGAA CTGAAGAAGT TTTACTGACG  60

TTCAAGATAT TCCTTGTCAT CATTTGTCTT CATGTCGTTC TGGTAACATC CCTGGAAGAA 120

GATACTGATA ATTCCAGTTT GTCACCACCA CCTGATGTTA CTTTAAGCTT ACTCCCTTCA 180

AACGAAACAG AAAAAACTAA AATCACTATA GTAAAAACCT TCAATGCTTC AGGCGTCAAA 240

CCCCAGAGAA ATATCTGCAA TTTGTCATCT ATTTGCAATG ACTCAGCATT TTTTAGAGGT 300

GAGATCATGT TCAATATGA TAAAGAAAGC ACTGTTCCCC AGAATCAACA TATAACGAAT 360

GGCACCTTAA CTGGAGTCCT GTCTCTAAGT GAATTAAACA CATTAAATTG TACATTCACA 420

ATAAAACTGA ATAATACAAT GAATGCATGT GCTGTAATAG CTGCTTTGGA AAGAGTAAAG 480

ATTCGACCAA TGGAACACTG CTGCTGTTCT GTCAGGATAC CCTGCCCTTC CTCCCCAGAA 540

GAGTTGGAAA AGCTTCAGTG TGACCTCCAG GATCCCATTG TCTGTCTTGC TGACCATCCA 600

CGTGGCCCAC CATTTTCTTC CAGCCAATCC ATCCCAGTGG TGCCTCGGGC CACTGTGCTT 660
```

TABLE 20-continued

```
TCCCAGGTCC CCAAAGCTAC CTCTTTTGCT GAGCCTCCAG ATTATTCACC TGTGACCCAC  720
AATGTTCCCT CTCCAATAGG GGAGATTCAA CCCCTTTCAC CCCAGCCTTC AGCTCCCATA  780
GCTTCCAGCC CTGCCATTGA CATGCCCCCA CAGTCTGAAA CGATCTCTTC CCCTATGCCC  840
CAAACCCATG TCTCCGGCAC CCCACCTCCT GTGAAAGCCT CATTTTCCTC TCCCACCGTG  900
TCTGCCCCTG CGAATGTCAA CACTACCAGC GCACCTCCTG TCCAGACAGA CATCGTCAAC  960
ACCAGCAGTA TTTCTGATCT TGAGAACCAA GTGTTGCAGA TGGAGAAGGC TCTGTCCTTG 1020
GGCAGCCTGG AGCCTAACCT CGCAGGACAA ATGATCAACC AAGTCAGCAG ACTCCTTCAT 1080
TCCCCGCCTG ACATGCTGGC CCCTCTGGCT CAAAGATTGC TGAAAGTAGT GGATGACATT 1140
GGCCTACAGC TGAACTTTTC AAACACGACT ATAAGTCTAA CCTCCCCTTC TTTGGCTCTG 1200
GCTGTGATCA GAGTGAATGC CAGTAGTTTC AACACAACTA CCTTTGTGGC CCAAGACCCT 1260
GCAAATCTTC AGGTTTCTCT GGAAACCCAA GCTCCTGAGA ACAGTATTGG CACAATTACT 1320
CTTCCTTCAT CGCTGATGAA TAATTTACCA GCTCATGACA TGGAGCTAGC TTCCAGGGTT 1380
CAGTTCAATT TTTTTGAAAC ACCTGCTTTG TTTCAGGATC CTTCCCTGGA GAACCTCTCT 1440
CTGATCAGCT ACGTCATATC ATCGAGTGTT GCAAACCTGA CCGTCAGGAA CTTGACAAGA 1500
AACGTGACAG TCACATTAAA GCACATCAAC CCGAGCCAGG ATGAGTTAAC AGTGAGATGT 1560
GTATTTTGGG ACTTGGGCAG AAATGGTGGC AGAGGAGGCT GGTCAGACAA TGGCTGCTCT 1620
GTCAAAGACA GGAGATTGAA TGAAACCATC TGTACCTGTA GCCATCTAAC AAGCTTCGGC 1680
GTTCTGCTGG ACCTATCTAG GACATCTGTG CTGCCTGCTC AAATGATGGC TCTGACGTTC 1740
ATTACATATA TTGGTTGTGG GCTTTCATCA ATTTTTCTGT CAGTGACTCT TGTAACCTAC 1800
ATAGCTTTTG AAAAGATCCG GAGGGATTAC CCTTCCAAAA TCCTCATCCA GCTGTGTGCT 1860
GCTCTGCTTC TGCTGAACCT GGTCTTCCTC CTGGACTCGT GGATTGCTCT GTATAAGATG 1920
CAAGGCCTCT GCATCTCAGT GGCTGTATTT CTTCATTATT TTCTCTTGGT CTCATTCACA 1980
TGGATGGGCC TAGAAGCATT CCATATGTAC CTGGCCCTTG TCAAAGTATT TAATACTTAC 2040
ATCCGAAAAT ACATCCTTAA ATTCTGCATT GTCGGTTGGG GGTACCAGC TGTGGTTGTG 2100
ACCATCATCC TGACTATATC CCCAGATAAC TATGGGCTTG GATCCTATGG GAAATTCCCC 2160
AATGGTTCAC CGGATGACTT CTGCTGGATC AACAACAATG CAGTATTCTA CATTACGGTG 2220
GTGGGATATT TCTGTGTGAT ATTTTTGCTG AACGTCAGCA TGTTCATTGT GGTCCTGGTT 2280
CAGCTCTGTC GAATTAAAAA GAAGAAGCAA CTGGGAGCCC AGCGAAAAAC CAGTATTCAA 2340
GACCTCAGGA GTATCGCTGG CCTTACATTT TTACTGGGAA TAACTTGGGG CTTTGCCTTC 2400
TTTGCCTGGG GACCAGTTAA CGTGACCTTC ATGTATCTGT TTGCCATCTT TAATACCTTA 2460
CAAGGATTTT TCATATTCAT CTTTTACTGT GTGGCCAAAG AAAATGTCAG GAAGCAATGG 2520
AGGCGGTATC TTTGTTGTGG AAAGTTACGG CTGGCTGAAA ATTCTGACTG GAGTAAAACT 2580
GCTACTAATG GTTTAAAGAA GCAGACTGTA AACCAAGGAG TGTCCAGCTC TTCAAATTCC 2640
TTACAGTCAA GCAGTAACTC CACTAACTCC ACCACACTGC TAGTGAATAA TGATTGCTCA 2700
GTACACGCAA GCGGGAATGG AAATGCTTCT ACAGAGAGGA ATGGGTCTC TTTTAGTGTT 2760
CAGAATGGAG ATGTGTGCCT TCACGATTTC ACTGGAAAAC AGCACATGTT AACGAGAAG 2820
GAAGATTCCT GCAATGGGAA AGGCCGTATG GCTCTCAGAA GGACTTCAAA GCGGGGAAGC 2880
TTACACTTTA TTGAGCAAAT GTGA
```

TABLE 20-continued

```
SEQ ID NO: 16 Protein sequence
Protein Accession #: Eoe sequence
1          11         21         31         41         51
|          |          |          |          |          |
MVFSVRQCGH VGRTEEVLLT FKIFLVIICL HVVLVTSLEE DTDNSSLSPP PDVTLSLLPS  60

NETEKTKITI VKTFNASGVK PQRNICNLSS ICNDSAFFRG EIMFQYDKES TVPQNQHITN 120

GTLTGVLSLS ELNTLNCTFT IKLNNTMNAC AVIAALERVK IRPMEHCCCS VRIPCPSSPE 180

ELEKLQCDLQ DPIVCLADHP RGPPFSSSQS IPVVPRATVL SQVPKATSFA EPPDYSPVTH 240

NVPSPIGEIQ PLSPQPSAPI ASSPAIDMPP QSETISSPMP QTHVSGTPPP VKASFSSPTV 300

SAPANVNTTS APPVQTDIVN TSSISDLENQ VLQMEKALSL GSLEPNLAGE MINQVSRLLH 360

SPPDMLAPLA QRLLKVVDDI GLQLNFSNTT ISLTSPSLAL AVIRVNASSF NTTTFVAQDP 420

ANLQVSLETQ APENSIGTIT LPSSLMNNLP AHDMELASRV QFNFFETPAL EQDPSLENLS 480

LISYVISSSV ANLTVRNLTR NVTVTLKHIN PSQDELTVRC VFWDLGRNGG RGGWSDNGCS 540

VKDRRLNETI CTCSHLTSFG VLLDLSRTSV LPAQMMALTF ITYIGCGLSS IFLSVTLVTY 600

IAFEKIRRDY PSKILIQLCA ALLLLNLVFL LDSWIALYKM QGLCISVAVF LHYFLLVSFT 660

WMGLEAFNMY LALVKVFNTY IRKYILKFCI VGWGVPAVVV TIILTISPDN YGLGSYGKFP 720

NGSPDDFCWI NNNAVFYITV VGYFCVIFLL NVSMFIVVLV QLCRIKKKKQ LGAQRKTSIQ 780

DLRSIAGLTF LLGITWGFAF FAWGPVNVTF MYLFAIFNTL QGFFIFIFYC VAKENVRKQW 840

RRYLCCGKLR LAENSDWSKT ATNGLKKQTV NQGVSSSSNS LQSSSNSTNS TTLLVNNDCS 900

VHASGNGNAS TERNGVSFSV QNGDVCLHDF TGKQNNFNEK EDSCNGKGRM ALRRTSKRGS 960

LNFIEQM

SEQ ID NO: 17 DNA sequence
Nucleic Acid Accession #: Eos sequence
Coding sequence: 1..2811
1          11         21         31         41         51
|          |          |          |          |          |
ATGCTTTTCT CTGTCAGGCA GTGTGGCCAT GTTCGCAGAA CTGAAGAAGT TTTACTGACG   60

TTCAAGATAT TCCTTGTCAT CATTTGTCTT CATGTCGTTC TGGTAACATC CCTGGAAGAA  120

GATACTGATA ATTCCAGTTT GTCACCACCA CCTGAGGTTG AAACAACAAG CCTCAATGAT  180

GTTACTTTAA GCTTACTCCC TTCAAACGAA ACAGGCGTCA AACCCCAGAG AAATATCTGC  240

AATTTGTCAT CTATTTGCAA TGACTCAGCA TTTTTTAGAG GTGAGATCAT GTTTCAATAT  300

GATAAAGAAA GCACTGTTCC CCAGAATCAA CATATAACGA ATGGCACCTT AACTGGAGTC  360

CTGTCTCTAA GTGAATTAAA ACGCTCAGAG CTCAACAAAA CCCTGCAAAC CCTAAGTGAG  420

ACTTACTTTA TAATGTGTGC TACAGCAGAG GCCCAAAGCA CATTAAATTG TACATTCACA  480

ATAAAACTGA ATAATACAAT GAATGCATGT GCTGTAATAG CTGGTTTGGA AAGAGTAAAG  540

ATTCGACCAA TGGAACACTG CTGCTGTTCT GTCAGGATAC CCTGCCCTTC CTCCCCAGAA  600

GAGTTGGAAA AGCTTCAGTG TGACGTGCAG GATCCCATTG TCTGTCTTGC TGACCATCCA  660

CGTGGCCCAC CATTTTCTTC CAGCCAATCC ATCCCAGTGG TGCCTCGGGC CACTGTGCTT  720

TCCCAGGTCC CCAAAGCTAC CTCTTTTGCT GAGCCTCCAG ATTATTCACC TGTGACCCAC  780

AATGTTCCCT CTCCAATAGG GGAGATTCAA CCCCTTTCAC CCCAGCCTTC AGCTCCCATA  840

GCTTCCAGCC CTGCCATTGA CATGCCCCCA CAGTCTGAAA CGATCTCTTC CCCTATGCCC  900

CAAACCCATG TCTCCGGCAC CCCACCTCCT GTGAAAGCCT CATTTTCCTC TCCCACCGTG  960

TCTGCCCCTG CGAATGTCAA CACTACCAGC GCACCTCCTG TCCAGACAGA CATCGTCAAC 1020

ACCAGCAGTA TTTCTGATCT TGAGAACCAA GTGTTGCAGA TGGAGAAGGC TCTGTCCTTG 1080
```

TABLE 20-continued

```
GGCAGCCTGG AGCCTAACCT CGCAGGAGAA ATGATCAACC AAGTCAGCAG ACTCCTTCAT 1140
TCCCCGCCTG ACATGCTGGC CCCTCTGGCT CAAAGATTGC TGAAAGTAGT GGATGACATT 1200
GGCCTACAGC TGAACTTTTC AAACACGACT ATAAGTCTAA CCTCCCCTTC TTTGGCTCTG 1260
GCTGTGATCA GAGTGAATGC CAGTAGTTTC AACACAACTA CCTTTGTGGC CCAAGACCCT 1320
GCAAATCTTC AGGTTTCTCT GGAAACCCAA GCTGCTGAGA ACACTATTGG CACAATTACT 1380
CTTCCTTCAT CGCTGATGAA TAATTTACCA GCTCATGACA TGGAGCTAGC TTCCAGGGTT 1440
CAGTTCAATT TTTTTGAAAC ACCTGCTTTG TTTCAGGATC CTTCCCTGGA GAACCTCTCT 1500
CTGATCAGCT ACGTCATATC ATCGAGTGTT GCAAACCTGA CCGTCAGGAA CTTGACAAGA 1560
AACGTGACAG TCACATTAAA GCACATCAAC CCGAGCCAGG ATGAGTTAAC AGTGAGATGT 1620
GTATTTTGGG ACTTGGGCAG AAATGGTGGC AGAGGAGGCT GGTCAGACAA TGGCTGCTCT 1680
GTCAAAGACA GGAGATTGAA TGAAACCATC TGTACCTGTA GCCATCTAAC AAGCTTCGGC 1740
GTTCTGCTGG ACCTATCTAG GACATCTGTG CTGCCTGCTC AAATGATGGC TCTGACGTTC 1800
ATTACATATA TTGGTTGTGG GCTTTCATCA ATTTTTCTGT CAGTGACTCT TGTAACCTAC 1860
ATAGCTTTTG AAAAGATCCG GAGGGATTAC CCTTCCAAAA TCCTCATCCA GCTGTGTGCT 1920
GCTCTGCTTC TGCTGAACCT GGTCTTCCTC CTGGACTCGT GGATTGCTCT GTATAAGATG 1980
CAAGGCCTCT GCATCTCAGT GGCTGTATTT CTTCATTATT TTCTCTTGGT CTCATTCACA 2040
TGGATGGGCC TAGAAGCATT CCATATGTAC CTGGCCCTTG TCAAAGTATT AATACTTAC  2100
ATCCGAAAAT ACATCCTTAA ATTCTGCATT GTCGGTTGGG GGGTACCAGC TGTGGTTGTG 2160
ACCATCATCC TGACTATATC CCCAGATAAC TATGGGCTTG GATCCTATGG GAAATTCCCC 2220
AATGGTTCAC CGGATGACTT CTGCTGGATC AACAACAATG CAGTATTCTA CATTACGGTG 2280
GTGGGATATT TCTGTGTGAT ATTTTGCTG AACGTCAGCA TGTTCATTGT GGTCCTGGTT 2340
CAGCTCTGTC GAATTAAAAA GAAGAAGCAA CTGGGAGCCC AGCGAAAAAC CAGTATTCAA 2400
GACCTCAGGA GTATCGCTGG CCTTACATTT TTACTGGGAA TAACTTGGGG CTTTGCCTTC 2460
TTTGCCTGGG GACCAGTTAA CGTGACCTTC ATGTATCTGT TTGCCATCTT TAATACCTTA 2520
CAAGGATTTT TCATATTCAT CTTTTACTGT GTGGCCAAAG AAAATGTCAG GAAGCAATGG 2580
AGGCGGTATG TTTGTTGTGG AAAGTTACGG CTGGCTGAAA ATTCTGGAAA TGCTTCTACA 2640
GAGAGGAATG GGGTCTCTTT TAGTGTTCAG AATGGAGATG TGTGCCTTCA CGATTTCACT 2700
GGAAAACAGC ACATGTTTAA CGAGAAGGAA GATTCCTGCA ATGGGAAAGG CCGTATGGCT 2760
CTCAGAAGGA CTTCAAAGCG GGGAAGCTTA CACTTTATTG AGCAAATGTG A
SEQ ID NO: 18 Protein sequence
Protein Accession #: Eos sequence
1          11         21         31         41         51
|          |          |          |          |          |
MVFSVRQCGH VGRTEEVLLT FKIFLVIICL HVVLVTSLEE DTDNSSLSPP PEVETTSLND  60
VTLSLLPSNE TGVKPQRNIC NLSSICNDSA FFRGEIMFQY DKESTVPQNQ HITNGTLTGV 120
LSLSELKRSE LNKTLQTLSE TYFIMCATAE AQSTLNCTFT IKLNNTMNAC AVIAALERVK 180
IRPMEHCCCS VRIPCPSSPE ELEKLQCDLQ DPIVCLADHP RGPPFSSSQS IPVVPRATVL 240
SQVPKATSFA EPPDYSPVTN NVPSPIGEIQ PLSPQPSAPI ASSPAIDMPP QSETISSPMP 300
QTHVSGTPPP VKASPSSPTV SAPANVNTTS APPVQTDIVN TSSISDLENQ VLQMEKALSL 360
GSLEPNLAGE MINQVSRLLH SPPDMLAPLA QRLLKVVDDI GLQLNFSNTT ISLTSPSLAL 420
AVIRVNASSF NTTTPVAQDP ANLQVSLETQ APENSIGTIT LPSSLMNNLP AHDMELASRV 480
QFNFFETPAL FQDPSLENLS LISYVISSSV ANLTVRNLTR NVTVTLKHIN PSQDELTVRC 540
```

TABLE 20-continued

```
VFWDLGRNGG RGGWSDNGCS VKDRRLNETI CTCSHLTSFG VLLDLSRTSV LPAQMMALTF  600

ITYIGCGLSE IFLSVTLVTY IAFEKIRRDY PSKILIQLCA ALLLLNLVFL LDSWIALYKM  660

QGLCISVAVF LHYFLLVSFT WMGLEAFHMY LALVKVFNTY IRKYILKFCI VGWGVPAVVV  720

TIILTISPDN YGLGSYGKFP NGSPDDFCWI NNNAVFYITV VGYFCVIFLL NVSMFIVVLV  780

QLCRIKKKKQ LGAQRKTSIQ DLRSIAGLTF LLGITWGFAF FAWGPVNVTF MYLFAIFNTL  840

QGFFIFIFYC VAKENVRKQW RRYLCCGKLR LAENSGNAST ERNGVSFSVQ NGDVCLHDFT  900

GKQHMFNEKE DSCNGKGRMA LRRTSKRGSL HFIEQM

SEQ ID NO: 19 DNA sequence
Nucleic Acid Accession #: Eos sequence
Coding sequence: 1..3045
1          11         21         31         41         51
|          |          |          |          |          |
ATGGTTTTCT CTGTCAGGCA GTGTGGCCAT GTTGGCAGAA CTGAAGAAGT TTTACTCACG   60

TTCAAGATAT TCCTTGTCAT CATTTGTCTT CATGTCGTTC TGGTAACATC CCTGGAAGAA  120

GATACTGATA ATTCCAGTTT GTCACCACCA CCTGCTAAAT TATCTGTTGT CAGTTTTGCC  180

CCCTCCTCCA ATGAGGTTGA ACAACAAGC CTCAATGATG TTACTTTAAG CTTACTCCCT  240

TCAAACGAAA CAGAAAAAAC TAAAATCACT ATAGTAAAAA CCTTCAATCC TTCAGGCGTC  300

AAACCCCAGA GAAATATCTG CAATTTGTCA TCTATTTGCA ATGACTCAGC ATTTTTTAGA  360

GGTGAGATCA TGTTTCAATA TGATAAAGAA AGCACTGTTG CCCAGAATCA ACATATAACG  420

AATGGCACCT TAACTGGAGT CCTGTCTCTA AGTGAATTAA AACGCTCAGA GCTCAACAAA  480

ACCCTGCAAA CCCTAAGTGA GACTTACTTT ATAATGTGTG CTACAGCAGA GGCCCAAAGC  540

ACATTAAATT GTACATTCAC AATAAAACTG AATAATACAA TGAATGCATG TGCTGCAATA  600

GCCGCTTTGG AAAGAGTAAA GATTCGACCA ATGGAACACT GCTGCTGTTC TGTCAGGATA  660

CCCTGCCCTT CCTCCCCAGA GAGTTGGGA AAGCTTCAGT GTGACCTGCA GGATCCCATT   720

GTCTGTCTTG CTGACCATCC ACGTGGCCCA CCATTTTCTT CCAGCCAATC CATCCCAGTG  780

GTGCCTCGGG CCACTGTGCT TTCCCAGGTC CCCAAAGCTA CCTCTTTTGC TGAGCCTCCA  840

GATTATTCAC CTGTGACCCA CAATGTTCCC TCTCCAATAG GGAGATTCA ACCCCTTTCA   900

CCCCAGCCTT CAGCTCCCAT AGCTTCCAGC CCTGCCATTG ACATGCCCCC ACAGTCTGAA  960

ACGATCTCTT CCCCTATGCC CCAAACCCAT GTCTCCGGCA CCCCACCTCC TGTGAAAGCC 1020

TCATTTTCCT CTCCCACCGT GTCTGCCCCT GCGAATGTCA ACACTACCAG CGCACCTCCT 1080

GTCCAGACAG ACATCGTCAA CACCAGCAGT ATTTCTGATC TTGAGAACCA AGTGTTGCAG 1140

ATGGAGAAGG CTCTGTCCTT GGGCAGCCTG GAGCCTAACC TCGCAGGAGA AATGATCAAC 1200

CAAGTCACCA GACTCCTTCA TTCCCCGCCT GACATGCTGG CCCCTCTGGC TCAAAGATTG 1260

CTGAAAGTAG TGGATGACAT TGGCCTACAG CTGAACTTTT CAAACACGAC TATAAGTCTA 1320

ACCTCCCCTT CTTTGGCTCT GGCTGTGATC AGAGTGAATG CCAGTAGTTT CAACACAACT 1380

ACCTTTGTGG CCCAAGACCC TGCAAATCTT CAGGTTTCTC TGGAAACCCA AGCTCCTGAG 1440

AACAGTATTG GCACAATTAC TCTTCCTTCA TCGCTGATGA ATAATTTACC AGCTCATGAC 1500

ATGGAGCTAG CTTCCAGGGT TCAGTTCAAT TTTTTTGAAA CACCTGCTTT GTTTCAGGAT 1560

CCTTCCCTGG AGAACCTCTC TCTGATCAGC TACGTCATAT CATCGAGTGT TGCAAACCTG 1620

ACCGTCAGGA ACTTGACAAG AAACGTGACA GTCACATTAA AGCACATCAA CCCGAGCCAG 1680

GATGAGTTAA CACTGAGATG TGTATTTTGG GACTTGGGCA GAAATGGTGG CAGAGGAGGC 1740

TGGTCAGACA ATGGCTGCTC TGTCAAAGAC AGGAGATTGA ATGAAACCAT CTGTACCTGT 1800
```

TABLE 20-continued

```
AGCCATCTAA CAAGCTTCGG CGTTCTGCTG GACCTATCTA GGACATCTGT GCTGCCTGCT 1860
CAAATGATGG CTCTGACGTT CATTACATAT ATTGGTTGTG GGCTTTCATC AATTTTTCTG 1920
TCAGTGACTC TTGTAACCTA CATACCTTTT GAAAAGATCC GGAGGGATTA CCCTTCCAAA 1980
ATCCTCATCC AGCTGTGTGC TGCTCTGCTT CTGCTGAACC TGGTCTTCCT CCTGGACTCG 2040
TGGATTGCTC TGTATAAGAT GCAAGGCCTC TGCATCTCAG TGGCTGTATT TCTTCATTAT 2100
TTTCTCTTGG TCTCATTCAC ATGGATGGGC CTAGAAGCAT TCCATATGTA CCTGGCCCTT 2160
GTCAAAGTAT TTAATACTTA CATCCGAAAA TACATCCTTA AATTCTGCAT TGTCGGTTGG 2220
GGGGTACCAG CTGTGGTTGT GACCATCATC CTGACTATAT CCCCAGATAA CTATCGGCTT 2280
GGATCCTATG GAAATTCCC CAATGGTTCA CCGGATGACT TCTGCTGGAT CAACAACAAT 2340
GCAGTATTCT ACATTACGGT GGTGGATAT TTCTGTGTCA TATTTTTGCT GAACGTCAGC 2400
ATGTTCATTG TGGTCCTGGT TCAGCTCTGT CGAATTAAAA AGAAGAAGCA ACTGGGAGCC 2460
CAGCGAAAAA CCAGTATTCA AGACCTCAGG AGTATCGCTG GCCTTACATT TTTACTGGGA 2520
ATAACTTGGG GCTTTGCCTT CTTTGCCTGG GGACCAGTTA ACGTGACCTT CATGTATCTG 2580
TTTGCCATCT TTAATACCTT ACAAGGATTT TTCATATTCA TCTTTTACTG TGTGGCCAAA 2640
GAAAATGTCA GGAAGCAATG GACGCGGTAT CTTTGTTGTC GAAAGTTACG GCTGGCTGAA 2700
AATTCTGACT GGAGTAAAAC TGCTACTAAT GGTTTAAAGA AGCAGACTGT AAACCAAGGA 2760
GTGTCCAGCT CTTCAAATTC CTTACAGTCA AGCAGTAACT CCACTAACTC CACCACACTG 2820
CTAGTGAATA ATGATTGCTC AGTACACGCA AGCGGGAATG GAAATGCTTC TACAGAGAGG 2880
AATGGGGTCT CTTTTAGTGT TCAGAATGGA GATGTGTGCC TTCACGATTT CACTGGAAAA 2940
CAGCACATGT TTAACGAGAA GGAAGATTCC TGCAATGGGA AAGGCCGTAT GGCTCTCAGA 3000
AGGACTTCAA AGCGGGGAAG CTTACACTTT ATTGAGCAAA TGTGA
```

SEQ ID NO: 20 Protein sequence
Protein Accession #: Eos sequence

```
1           11         21         31         41         51
|           |          |          |          |          |
MVFNVRQCGH VGRTEEVLLT FKIFLVIICL HVVLVTSLEE DTDNNSLSPP PAKLSVVSFA  60
PSNNEVETTS LNDVTLSLLP SNETEKTKIT IVKTFNASGV KPQRNICNLS SICNDSAFFR 120
GEIMFQYDKE STVPQNQHIT NGTLTGVLSL SELKRSELNK TLQTLSETYF IMCATAEAQS 190
TLNCTFTIKL NNTMNACAAI AALERVKIRP MEHCCCSVRI PCPSSPEELG KLQCDLQDPI 240
VCLADHPRGP PFSSSQSIPV VPRATVLSQV PKATSFAEPP DYSPVTHNVP SPIGEIQPLS 300
PQPSAPIASS PAIDMPPQSE TISSPMPQTH VSGTPPPVKA SFSSPTVSAP ANVNTTSAPP 360
VQTDIVNTSS ISDLENQVLQ MEKALSLGSL EPNLAGEMIN QVSRLLHSPP DMLAPLAQRL 420
LKVVDDIGLQ LNFSNTTISL TSPSLALAVI RVNASSFNTT TFVAQDPANL QVSLETQAPE 480
NSIGTITLPS SLMNNLPAHD MELASRVQFN FFETPALFQD PSLENLSLIS YVISSSVANL 540
TVRNLTRNVT VTLKHINPSQ DELTVRCVFN DLGRNGGRGG WSDNGCSVKD RRLNETICTC 600
SHLTSPGVLL DLSRTSVLPA QMMALTFITY IGCGLSSIFL SVTLVTYIAF EKIRRDYPSK 660
ILIQLCAALL LLNLVFLLDS WIALYKMQGL CISVAVFLHY FLLVSFTWMG LEAFHMYLAL 720
VKVFNTYIRK YILKFCIVGW GVPAVVVTII LTISPDNYGL GSYGKFPNGS PDDFCWINNN 780
AVFYITVVGY FCVIFLLNVS MFIVVLVQLC RIKKKKQLGA QRKTSIQDLR SIAGLTFLLG 840
ITWGFAFFAW GPVNVTFMYL FAIFNTLQGF FIFIFYCVAK ENVRKQWRRY LCCGKLRLAE 900
NSDWSKTATN GLKKQTVNQG VSSSSNSLQN SSNSTNSTTL LVNNDCSVHA SGNGNASTER 960
NGVSFSVQNG DVCLHDFTGK QHMFNEKEDS CNGKGRMALR RTSKRGSLNF IEQM
```

TABLE 20-continued

```
SEQ ID NO: 21 DNA sequence
Nucleic Acid Accession #: NM_005756 1
Coding sequence: 37..3117
1          11         21         31         41         51
|          |          |          |          |          |
AGCCAGCCCG AGGACGCGAC CGGCAGGTGT GCACAGAGGT TCTCCACTTT GTTTTCTGAA  60

CTCGCGGTCA GGATGGTTTT CTCTGTCAGG CAGTGTGGCC ATGTTGGCAG AACTGAAGAA  120

GTTTTACTGA CGTTCAAGAT ATTCCTTGTC ATCATTTGTC TTCATGTCGT TCTGGTAACA  180

TCCCTGGAAG AAGATACTDA TAATTCCAGT TTGTCACCAC CACCTGCTAA ATTATCTGTT  240

GTCAGTTTTG CCCCCTCCTC CAATGAGGTT GAAACAACAA GCCTCAATGA TGTTACTTTA  300

AGCTTACTCC CTTCAAACGA AACAGAAAAA ACTAAAATCA CTATAGTAAA AACCTTCAAT  360

GCTTCAGGCG TCAAACCCCA GAGAAATATC TGCAATTTGT CATCTATTTG CAATGACTCA  420

GCATTTTTTA GAGGTGAGAT CATGTTTCAA TATGATAAAG AAAGCACTGT TCCCCAGAAT  480

CAACATATAA CGAATGGCAC CTTAACTGGA GTCCTGTCTC TAAGTGAATT AAAACGCTCA  540

GAGCTCAACA AAACCCTGCA AACCCTAAGT GAGACTTACT TTATAATGTG TGCTACAGCA  600

GAGGCCCAAA GCACATTAAA TTGTACATTC ACAATAAAAC TGAATAATAC AATGAATGCA  660

TGTGCTGCAA TAGCCGCTTT GGAAAGAGTA AAGATTCGAC CAATGGAACA CTGCTGCTGT  720

TCTGTCAGGA TACCCTGCCC TTCCTCCCCA GAAGAGTTGG GAAAGCTTCA GTGTGACCTG  780

CAGGATCCCA TTGTCTGTCT TGCTGACCAT CCACGTGGCC CACCATTTTC TTCCAGCCAA  840

TCCATCCCAG TGGTGCCTCG GGCCACTGTG CTTTCCCAGG TCCCCAAAGC TACCTCTTTT  900

GCTGAGCCTC CAGATTATTC ACCTGTGACC CACAATGTTC CCTCTCCAAT AGGGGAGATT  960

CAACCCCTTT CACCCCAGCC TTCAGCTCCC ATAGCTTCCA GCCCTGCCAT TGACATGCCC  1020

CCACAGTCTG AAACGATCTC TTCCCCTATG CCCCAAACCC ATGTCTCCGG CACCCCACCT  1080

CCTGTGAAAG CCTCATTTTC CTCTCCCACC GTGTCTGCCC CTGCGAATGT CAACACTACC  1140

AGCGCACCTC CTGTCCAGAC AGACATCGTC AACACCAGCA GTATTTCTGA TCTTGAGAAC  1200

CAAGTGTTGC AGATGGAGAA GGCTCTGTCC TTGGGCAGCC TGGAGCCTAA CCTCGCAGGA  1260

GAAATGATCA ACCAAGTCAG CAGACTCCTT CATTCCCCGC CTGACATGCT GGCCCCTCTG  1320

GCTCAAAGAT TGCTGAAAGT AGTGGATGAC ATTGGCCTAC AGCTGAACTT TCAAACACG  1380

ACTATAAGTC TAACCTCCCC TTCTTTGGCT CTGGCTGTGA TCAGAGTGAA TGCCAGTAGT  1440

TTCAACACAA CTACCTTTGT GGCCCAAGAC CCTGCAAATC TTCAGGTTTC TCTGGAAACC  1500

CAAGCTCCTG AGAACAGTAT TGGCACAATT ACTCTTCCTT CATCGCTGAT GAATAATTTA  1560

CCAGCTCATG ACATGGAGCT AGCTTCCAGG GTTCAGTTCA ATTTTTTTGA AACACCTGCT  1620

TTGTTTCAGG ATCCTTCCCT GGAGAACCTC TCTCTGATCA GCTACGTCAT ATCATCGAGT  1680

GTTGCAAACC TGACCGTCAG GAACTTGACA AGAAACGTGA CAGTCACATT AAAGCACATC  1740

AACCCGAGCC AGGATGAGTT AACAGTGAGA TGTGTATTTT GGGACTTGGG CAGAAATGGT  1600

GGCAGAGGAG GCTGGTCAGA CAATGGCTGC TCTGTCAAAG ACAGGAGATT GAATGAAACC  1860

ATCTGTACCT GTAGCCATCT AACAAGCTTC GGCGTTCTGC TGGACCTATC TAGGACATCT  1920

GTGCTGCCTG CTCAAATGAT GGCTCTGACG TTCATTACAT ATATTGGTTG TGGGCTTTCA  1980

TCAATTTTTC TGTCAGTGAC TCTTGTAACC TACATAGCTT TGAAAAGAT CCGGAGGGAT  2040

TACCCTTCCA AAATCCTCAT CCAGCTGTGT GCTGCTCTGC TTCTGCTGAA CCTGGTCTTC  2100

CTCCTGGACT CGTGGATTGC TCTGTATAAG ATGCAAGGCC TCTGCATCTC AGTGGCTGTA  2160

TTTCTTCATT ATTTTCTCTT GGTCTCATTC ACATGGATGG CCTAGAAGC ATTCCATATG  2220
```

TABLE 20-continued

```
TACCTGGCCC TTGTCAAAGT ATTTAATACT TACATCCGAA AATACATCCT TAAATTCTGC  2280

ATTGTCGGTT GGGGGGTACC AGCTGTGGTT GTGACCATCA TCCTGACTAT ATCCCCAGAT  2340

AACTATGGGC TTGGATCCTA TGGGAAATTC CCCAATGGTT CACCGGATGA CTTCTGCTGG  2400

ATCAACAACA ATGCAGTATT CTACATTACG GTGGTGGGAT ATTTCTGTGT GATATTTTTG  2460

CTGAACGTCA GCATGTTCAT TGTGGTCCTG GTTCAGCTCT GTCGAATTAA AAAGAAGAAG  2520

CAACTGGGAG CCCAGCGAAA AACCAGTATT CAAGACCTCA GGAGTATCGC TGGCCTTACA  2580

TTTTTACTGG GAATAACTTG GGGCTTTGCC TTCTTTGCCT GGGGACCAGT TAACGTGACC  2640

TTCATGTATC TGTTTGCCAT CTTTAATACC TTACAAGGAT TTTTCATATT CATCTTTTAC  2700

TGTGTGGCCA AAGAAAATGT CAGGAAGCAA TGGAGGCGGT ATCTTTGTTG TGGAAAGTTA  2760

CGGCTGGCTG AAAATTCTGA CTGGAGTAAA ACTGCTACTA ATGGTTTAAA GAAGCAGACT  2820

GTAAACCAAG GAGTGTCCAG CTCTTCAAAT TCCTTACAGT CAAGCAGTAA CTCCACTAAC  2880

TCCACCACAC TGCTAGTGAA TAATGATTGC TCAGTACACG CAAGCGGGAA TGGAAATGCT  2940

TCTACAGAGA GGAATGGGGT CTCTTTTAGT GTTCAGAATG GAGATGTGTG CCTTCACGAT  3000

TTCACTGGAA AACAGCACAT GTTTAACGAG AAGGAAGATT CCTGCAATGG GAAAGGCCGT  3060

ATGGCTCTCA GAAGGACTTC AAAGCGGGGA AGCTTACACT TTATTGAGCA AATGTGATTC  3120

CTTTCTTCTA AAATCAAAGC ATGATGCTTG ACAGTGTGAA ATGTCCAATT TTACCTTTTA  3180

CACAATGTGA GATGTATGAA AATCAACTCA TTTTATTCTC GGCAACATCT GGAGAAGCAT  3240

AAGCTAATTA AGGGCGATGA TTATTATTAC AAGAAGAAAC CAAGACATTA CCATGGTT   3300

TTTAGACATT TCTGATTTGG TTTCTTATCT TTCATTTTAT AAGAAGGTTG GTTTTAAACA  3360

ATACACTAAG AATGACTCCT ATAAAGAAAA CAAAAAAAGG TAGTGAACTT TCAGCTACCT  3420

TTTAAAGAGG CTAAGTTATC TTTGATAACA TCATATAAAG CAACTGTTGA CTTCAGCCTG  3480

TTGGTGAGTT TAGTTGTGCA TGCCTTTGTT GTATATAAGC TAAATTCTAG TGACCCATGT  3540

GTCAAAAATC TTACTTCTAC ATTTTTTTGT ATTTATTTTC TACTGTGTAA ATGTATTCCT  3600

TTGTAGAATC ATGGTTGTTT TGTCTCACGT GATAATTCAG AAAATCCTTG CTCGTTCCGC  3660

AAATCCTAAA GCTCCTTTTG GAGATGATAT AGGATGTGAA ATACAGAAAC CTCAGTGAAA  3720

TCAAGAAATA ATGATCCCAG CCAGACTGAG AAAATGTAAG CAGACAGTGC CACAGTTAGC  3780

TCATACAGTG CCTTTGAGCA AGTTAGGAAA AGATGCCCCC ACTGGGCAGA CACAGCCCTA  3840

TGGGTCATGG TTTGACAAAC AGAGTGAGAG ACCATATTTT AGCCCCACTC ACCCTCTTGG  3900

GTGCACGACC TGTACAGCCA AACACAGCAT CCAATATGAA TACCCATCCC CTGACCGCAT  3960

CCCCAGTAGT CAGATTATAG AATCTGCACC AAGATGTTTA GCTTTATACC TTGGCCACAG  4020

AGAGGGATGA ACTGTCATCC AGACCATGTG TCAGGAAAAT TGTGAACGTA GATGAGGTAC  4080

ATACACTGCC GCTTCTCAAA TCCCCAGAGC CTTTAGGAAC AGGAGAGTAG ACTAGGATTC  4140

CTTCTCTTAA AAAGGTACAT ATATATGGAA AAAAATCATA TTGCCGTTCT TTAAAAGGCA  4200

ACTGCATGGT ACATTGTTGA TTGTTATGAC TGGTACACTC TGGCCCAGCC AGAGCTATAA  4260

TTGTTTTTTA AATGTGTCTT GAAGAATGCA CAGTGACAAG GGGAGTAGCT ATTGGGAACA  4320

GGGAACTGTC CTACACTGCT ATTGTTGCTA CATGTATCGA GCCTTGATTG CTCCTAGTTA  4380

TATACAGGGT CTATCTTGCT TCCTACCTAC ATCTGCTTGA GCAGTGCCTC AAGTACATCC  4440

TTATTAGGAA CATTTCAAAC CCCTTTTAGT TAAGTCTTTC ACTAAGGTTC TCTTGCATAT  4500

ATTTCAAGTG AATGTTGGAT CTCAGACTAA CCATAGTAAT AATACACATT TCTGTGAGTG  4560
```

TABLE 20-continued

```
CTGACTTGTC TTTGCAATAT TTCTTTTCTG ATTTATTTAA TTTTCTTGTA TTTATATGTT 4620

AAAATCAAAA ATGTTAAAAT CAATGAAATA AATTTGCAGT TAAGA
```

SEQ ID NO: 22 Protein sequence
Protein Accession #: NP_005747.1

```
1          11         21         31         41         51
|          |          |          |          |          |
MVFSVRQCGH VGRTEEVLLT FKIFLVIICL HVVLVTSLEE DTDNSSLSPP PAKLSVVSFA  60
PSSNEVETTS LNDVTLSLLP SNETGVKPQR NICNLSSICN DSAFFRGEIM PQYDKESTVP 120
QNQHITNGTL TGVLSLSELK RSELNKTLQT LSETYFIMCA TAEAQSTLNC TFTIKLNNTM 180
NACAVIAALE RVKIRPMEHC CCSVRIPCPS SPEELEKLQC DLQDPIVCLA DHPRGPPFSS 240
SQSIPVVPRA TVLSQVPKAT SFAEPPDYSP VTHNVPSPIG EIQPLSPQPS APIASSPAID 300
MPPQSETISS PMPQTHVSGT PPPVKASFSS PTVSAPANVN TTSAPPVQTD IVNTSSISDL 360
ENQVLQMEKA LSLGSLEPNL AGEMINQVSR LLNSPPDMLA PLAQRLLKVV DDIGLQLNFS 420
NTTISLTSPS LALAVIRVNA SSFNTTTFVA QDPANLQVSL ETQAPENSIG TTTLPSSLMN 480
NLPAHDMELA SRVQFNFFET PALFQDPSLE NLSLISYVIS SSVANLTVRN LTRNVTVTLK 540
HINPSQDELT VRCVFWDLGR NGGRGGWSDN GCSVKDRRLN ETICTCSHLT SFGVLLDLSR 600
TSVLPAQMMA LTFITYIGCG LSSIFLSVTL VTYIAFEKIR RDYPSKILIQ LCAALLLLNL 660
VFLLDSWIAL YKMQGLCISV AVFLHYFLLV SFTWMGLEAF HMYLALVKVF NTYIRKYILK 720
FCIVGWGVPA VVVTIILTIS PDNYGLGSYG KFPNGSPDDF CWINNNAVFY ITVVGYFCVI 780
FLLNVSMFIV VLVQLCRIKK KKQLGAQRKT SIQDLRSIAG LTFLLGITWG FAFFAWGPVN 840
VTPMYLFAIF NTLQGFFIFI FYCVAKENVR KQWRRYLCCG KLRLAENSDW SKTATNGLKK 900
QTVNQGVSSS SNSLQSSSNS TNSTTLLVNN DCSVHASGNG NASTERNGVS FSVQNGDVCL 960
HDFTGKQHMF NEKEDSCNGK GRMALRRTSK RGSLHFIEQM
```

SEQ ID NO: 23 DNA sequence
Nucleic Acid Accession #: NM_001565.1
Coding sequence: 67..363

```
1          11         21         31         41         51
|          |          |          |          |          |
GAGACATTCC TCAATTGCTT AGACATATTC TGAGCCTACA GCAGAGGAAC CTCCAGTCTC  60
AGCACCATGA ATCAAACTGC GATTCTGATT TGCTGCCTTA TCTTTCTGAC TCTAAGTGGC 120
ATTCAAGGAG TACCTCTCTC TAGAACCGTA CGCTGTACCT GCATCAGCAT TAGTAATCAA 180
CCTGTTAATC CAAGGTCTTT AGAAAAACTT GAAATTATTC CTGCAAGCCA ATTTTGTCCA 240
CGTGTTGAGA TCATTGCTAC AATGAAAAAG AAGGGTGAGA AGAGATGTCT GAATCCAGAA 300
TCGAAGGCCA TCAAGAATTT ACTGAAAGCA GTTAGCAAGG AAATGTCTAA AAGATCTCCT 360
TAAAACCAGA GGGGAGCAAA ATCGATGCAG TGCTTCCAAG GATGGACCAC ACAGAGGCTG 420
CCTCTCCCAT CACTTCCCTA CATGGAGTAT ATGTCAAGCC ATAATTGTTC TTAGTTTGCA 480
GTTACACTAA AAGGTGACCA ATGATGGTCA CCAAATCAGC TGCTACTACT CCTGTAGGAA 540
GGTTAATGTT CATCATCCTA AGCTATTCAG TAATAACTCT ACCCTGGCAC TATAATGTAA 600
GCTCTACTGA GGTGCTATGT TCTTAGTGGA TGTTCTGACC CTGCTTCAAA TATTTCCCTC 660
ACCTTTCCCA TCTTCCAAGG GTACTAAGGA ATCTTTCTGC TTTGGGGTTT ATCAGAATTC 720
TCAGAATCTC AAATAACTAA AAGGTATGCA ATCAAATCTG CTTTTTAAAG AATGCTCTTT 780
ACTTCATGGA CTTCCACTGC CATCCTCCCA AGGGGCCCAA ATTCTTTCAG TGGCTACCTA 840
CATACAATTC CAAACACATA CAGGAAGGTA GAAATATCTG AAAATGTATG TGTAAGTATT 900
CTTATTTAAT GAAAGACTGT ACAAAGTATA AGTCTTAGAT GTATATATTT CCTATATTGT 960
```

TABLE 20-continued

```
TTTCAGTGTA CATGGAATAA CATGTAATTA AGTACTATGT ATCAATGAGT AACAGGAAAA 1020

TTTTAAAAAT ACAGATAGAT ATATGCTCTG CATGTTACAT AAGATAAATG TGCTGAATGG 1080

TTTTCAAATA AAAATGAGGT ACTCTCCTGG AAATATTAAG

SEQ ID NO: 24 Protein sequence
Protein Accession #: NP_001556.1
1          11         21         31         41         51
|          |          |          |          |          |
MNQTAILICC LIFLTLSGIQ GVPLSRTVRC TCISISNQPV NPRSLEKLEI IPASQFCPRV 60

EIIATMKKKG EKRCLNPESK AIKNLLKAVS KEMSKRSP

SEQ ID NO: 25 DNA sequence
Nucleic Acid Accession #: XM_030559
Coding sequence: 1..1119
1          11         21         31         41         51
|          |          |          |          |          |
ATGAACCGCA GCCACCGGCA CGGGGCGGGC AGCGGCTGCC TGGGCACTAT GGAGGTGAAG 60

AGCAAGTTTG GAGCTGAATT TCGTCGGTTT TCGCTGGAAA GATCAAAACC TGGAAAATTT 120

GAGGAGTTTT ATGGATTACT ACAACATGTT CATAAGATCC CCAATGTTGA CGTTTTGGTA 180

GGCTATGCAG ACATCCATGG AGACTTACTA CCTATAAATA ATGATGATAA TTATCACAAA 240

GCTGTTTCAA CGGCCAATCC ACTGCTTAGG ATATTTATAC AAAAGAAGGA AGAAGCAGAC 300

TACAGTGCCT TTGGTACAGA CACGCTAATA AAGAAGAAGA ATGTTTTAAC CAACGTATTG 360

CGTCCTGACA ACCATAGAAA AAAGCCACAT ATAGTCATTA GTATGCCCCA AGACTTTAGA 420

CCTGTGTCTT CTATTATAGA CGTGGATATT CTCCCAGAAA CGCATCGTAG GGTACGTCTT 480

TACAAATACG GCACGGAGAA ACCCCTAGGA TTCTACATCC GGGATGGCTC CAGTGTCAGG 540

GTAACACCAC ATGGCTTAGA AAAGGTTCCA GGGATCTTTA TATCCAGGCT TGTCCCAGGA 600

GGTCTGGCTC AAAGTACAGG ACTATTAGCT GTTAATGATG AAGTTTTAGA AGTTAATGGC 660

ATAGAAGTTT CAGGGAAGAG CCTTGATCAA GTAACAGACA TGATGATTGC AAATAGCCGT 720

AACCTCATCA TAACAGTGAG ACCGGCAAAC CAGAGGAATA ATGTTGTGAG AACAGTCGG 780

ACTTCTGGCA GTTCCGGTCA GTCTACTGAT AACAGCCTTC TTGGCTACCC ACAGCAGATT 840

GAACCAAGCT TTGAGCCAGA GGATGAAGAC AGCGAAGAAG ATGACATTAT CATTGAAGAC 900

AATGGAGTGC CACAGCAGAT TCCAAAAGCT GTTCCTAATA CTGAGAGCCT GGAGTCATTA 960

ACACAGATAG AGCTAAGCTT TGAGTCTGGA CAGAATGGCT TTATTCCCTC TAATGAAGTG 1020

AGCTTAGCAG CCATAGCAAG CAGCTCAAAC ACGGAATTTG AAACACATGC TCCAGATCAA 1080

AAACTCTTAG AAGAAGATGG AACAATCATA ACATTATGA

SEQ ID NO: 26 Protein sequence
Protein Accession #: XP_030559
1          11         21         31         41         51
|          |          |          |          |          |
MNRSHRHGAG SGCLGTMEVK SKPGAEFRRF SLERSKPGKF EEFYGLLQHV HKIPNVDVLV 60

GYADIHGDLL PINNDDNYNK AVSTANPLLR IFIQKKEEAD YSAFGTDTLI KKKNVLTNVL 120

RPDNHRKKPH IVISMPQDFR PVSSIIDVDI LPETHRRVRL YKYGTEKPLG FYIRDGSSVR 180

VTPHGLEKVP GIFISRLVPG GLAQSTGLLA VNDEVLEVNG IEVSGKSLDQ VTDMMIANSR 240

NLIITVRPAN QRNNVVRNSR TSGSSDQSTD NSLLGYPQQI EPSFEPEDED SEEDDIIIED 300

NGVPQQIPKA VPNTESLESL TQIELSFESG QNGFIPSNEV SLAAIASSSN TEFETHAPDQ 360

KLLEEDGTII TL
```

TABLE 20-continued

SEQ ID NO: 27 DNA sequence
Nucleic Acid Accession #: NM_003667.1
Coding sequence: 1. .2651

```
1         11         21         31         41         51
|          |          |          |          |          |
ATGGACACCT CCCGGCTCGG TGTGCTCCTG TCCTTGCCTG TGCTGCTGCA GCTGGCGACC  60

GGGGGCAGCT CTCCCAGGTC TGGTGTGTTG CTGAGGGGCT GCCCCACACA CTGTCATTGC  120

GAGCCCGACG GCAGGATGTT GCTCAGGGTG GACTGCTCCG ACCTGGGGCT CTCGGAGCTG  180

CCTTCCAACC TCAGCGTCTT CACCTCCTAC CTAGACCTCA GTATGAACAA CATCAGTCAG  240

CTGCTCCCGA ATCCCCTGCC CAGTCTCCGC TTCCTGGAGG AGTTACGTCT TGCGGGAAAC  300

GCTCTGACAT ACATTCCCAA GGGAGCATTC ACTGGCCTTT ACAGTCTTAA AGTTCTTATG  360

CTGCAGAATA ATCAGCTAAG ACACGTACCC ACAGAAGCTC TGCAGAATTT GCGAAGCCTT  420

CAATCCCTGC GTCTGGATGC TAACCACATC AGCTATGTGC CCCCAAGCTG TTTCAGTGGC  480

CTGCATTCCC TGAGGCACCT GTGGCTGGAT GACAATGCGT TAACAGAAAT CCCCGTCCAG  540

GCTTTTAGAA GTTTATCGGC ATTGCAAGCC ATGACCTTGG CCCTGAACAA ATACACCAC  600

ATACCAGACT ATGCCTTTGG AAACCTCTCC AGCTTGGTAG TTCTACATCT CCATAACAAT  660

AGAATCCACT CCCTGGGAAA GAAATGCTTT GATGGGCTCC ACAGCCTAGA GACTTTAGAT  720

TTAAATTACA ATAACCTTGA TGAATTCCCC ACTGCAATTA GGACACTCTC CAACCTTAAA  780

GAACTACATT TCTATGACAA TCCCATCCAA TTTGTTGGGA GATCTGCTTT TCAACATTTA  840

CCTGAACTAA GAACACTGAC TCTGAATGGT GCCTCACAAA TAACTGAATT TCCTGATTTA  900

ACTGGAACTG CAAACCTGGA GAGTCTGACT TTAACTGGAG CACAGATCTC ATCTCTTCCT  960

CAAACCGTCT GCAATCAGTT ACCTAATCTC CAAGTGCTAG ATCTGTCTTA CAACCTATTA  1020

GAAGATTTAC CCAGTTTTTC AGTCTGCCAA AAGCTTCAGA AAATTGACCT AAGACATAAT  1080

GAAATCTACG AAATTAAAGT TGACACTTTC CAGCAGTTGC TTAGCCTCCG ATCGCTGAAT  1140

TTGGCTTGGA ACAAAATTGC TATTATTCAC CCCAATGCAT TTTCCACTTT GCCATCCCTA  1200

ATAAAGCTGG ACCTATCGTC CAACCTCCTG TCGTCTTTTC CTATAACTGG GTTACATGGT  1260

TTAACTCACT TAAAATTAAC AGGAAATCAT GCCTTACAGA GCTTGATATC ATCTGAAAAC  1320

TTTCCAGAAC TCAAGGTTAT AGAAATGCCT TATGCTTACC AGTGCTGTGC ATTTGGAGTG  1380

TGTGAGAATG CCTATAAGAT TTCTAATCAA TGGAATAAAG GTGACAACAG CAGTATGGAC  1440

GACCTTCATA AGAAAGATGC TGGAATGTTT CAGGCTCAAG ATGAACGTGA CCTTGAAGAT  1500

TTCCTGCTTG ACTTTGAGGA AGACCTGAAA GCCCTTCATT CAGTGCAGTG TTCACCTTCC  1560

CCAGGCCCCT TCAAACCCTG TGAACACCTG CTTGATGGCT GGCTGATCAG AATTGGAGTG  1620

TGGACCATAG CAGTTCTGGC ACTTACTTGT AATGCTTTGG TGACTTCAAC AGTTTTCAGA  1680

TCCCCTCTGT ACATTTCCCC CATTAAACTG TTAATTGGGG TCATCGCAGC AGTGAACATG  1740

CTCACGGGAG TCTCCAGTGC CGTGCTGGCT GGTGTGGATG CGTTCACTTT TGGCAGCTTT  1800

GCACGACATG GTGCCTGGTG GGAGAATGGG GTTGGTTGCC ATGTCATTGG TTTTTTGTCC  1860

ATTTTTGCTT CAGAATCATC TGTTTTCCTG CTTACTCTGG CAGCCCTGGA GCGTGGGTTC  1920

TCTGTGAAAT ATTCTGCAAA ATTTGAAACG AAAGCTCCAT TTTCTAGCCT GAAAGTAATC  1980

ATTTTGCTCT GTGCCCTGCT GGCCTTGACC ATGGCCGCAG TTCCCCTGCT GGGTGGCAGC  2040

AAGTATGGCG CCTCCCCTCT CTGCCTGCCT TTGCCTTTTG GGGAGCCCAG CACCATGGGC  2100

TACATGGTCG CTCTCATCTT GCTCAATTCC CTTTGCTTCC TCATGATGAC CATTGCCTAC  2160

ACCAAGCTCT ACTGCAATTT GGACAAGGGA GACCTGGAGA ATATTTGGGA CTGCTCTATG  2220
```

TABLE 20-continued

```
GTAAAACACA TTGCCCTGTT GCTCTTCACC AACTGCATCC TAAACTGCCC TGTGGCTTTC 2280

TTGTCCTTCT CCTCTTTAAT AAACCTTACA TTTATCAGTC CTGAAGTAAT TAAGTTTATC 2340

CTTCTGGTGG TAGTCCCACT TCCTGCATGT CTCAATCCCC TTCTCTACAT CTTGTTCAAT 2400

CCTCACTTTA AGGAGGATCT GGTGAGCCTG AGAAAGCAAA CCTACGTCTG GACAAGATCA 2460

AAACACCCAA GCTTGATGTC AATTAACTCT GATGATGTCG AAAAACAGTC CTGTGACTCA 2520

ACTCAAGCCT TGGTAACCTT TACCAGCTCC AGCATCACTT ATGACCTGCC TCCCAGTTCC 2580

GTGCCATCAC CAGCTTATCC AGTGACTGAG AGCTGCCATC TTTCCTCTGT GGCATTTGTC 2640

CCATGTCTTA A
```

SEQ ID NO: 28 Protein sequence:
Protein Accession #: NP_003658.1

```
1          11         21         31         41         51
|          |          |          |          |          |
MDTSRLGVLL SLPVLLQLAT GGSSPRSGVL LRGCPTHCHC EPDGRMLLRV DCSDLGLSEL  60

PSNLSVFTSY LDLSMNNISQ LLPNPLPSLR FLEELRLAGN ALTYIPKGAF TGLYSLKVLM 120

LQNNQLRNVP TEALQNLRSL QSLRLDANHI SYVPPSCFSG LNSLRHLWLD DNALTEIPVQ 180

AFRSLSALQA MTLALNKIHH IPDYAFGNLS SLVVLHLHNN RIHSLGKKCF DGLHSLETLD 240

LNYNNLDEFP TAIRTLSNLK ELNFYDNPIQ FVGRSAFQHL PELRTLTLNG ASQITEFPDL 300

TGTANLESLT LTGAQISSLP QTVCNQLPNL QVLDLSYNLL EDLPSFSVCQ KLQRIDLRHN 360

EIYEIKVDTF QQLLSLRSLN LAWNKIAIIH PNAFSTLPSL IKLDLSSNLL SSFPITGLHG 420

LTHLKLTGNH ALQSLISSEN FPELKVIEMP YAYQCCAFGV CENAYKISNQ WNKGDNSSMD 480

DLHKKDAGMF QAQDERDLED FLLDFEEDLK ALHSVQCSPS PGPFKPCEHL LDGWLIRIGV 540

WTIAVLALTC NALVTSTVFR SPLYISPIKL LIGVIAAVNM LTGVSSAVLA GVDAFTFGSF 600

ARHGAWWENG VGCHVIGFLS IFASESSVFL LTLAALERGF SVKYSAKFET KAPFSSLKVI 660

ILLCALLALT MAAVPLLGGS KYGASPLCLP LPFGEPSTMG YMVALILLNS LCFLMMTIAY 720

TKLYCNLDKG DLENIWDCSN VKHIALLLFT NCILNCPVAF LSFSSLINLT FISPEVIKFI 780

LLVVVPLPAC LNPLLYILFN PHFKEDLVSL RKQTYVWTRS KHPSLMSINS DDVEKQSCDS 840

TQALVTFTSS SITYDLPPSS VPSPAYPVTE SCHLSSVAFV PCL
```

SEQ ID NO: 29 DNA sequence
Nucleic Acid Accession #. NM_002497.1
Coding sequence: 135. 1472

```
1          11         21         31         41         51
|          |          |          |          |          |
GGCACGAGTA GGGGTGGCGG GTCACTGCTG CTCGGGCGCT TCTCCATCCA GGTCCCTCGA  60

GTTCCTGGTC CCTGGAGCTC CGCACTTGGC GCGCAACCTG CGTGAGGCAG CGCGACTCTG 120

CCGACTGGCC GGCCATGCCT TCCCGGGCTG AGGACTATCA AGTGTTGTAC ACCATTGGCA 180

CAGGCTCCTA CGGCCGCTGC CAGAACATCC GGAGGAAGAG TGATGGCAAC ATATTAGTTT 240

GGAAACAACT TGACTATGGC TCCATGACAG AAGCTGAGAA ACAGATGCTT GTTTCTGAAG 300

TGAATTTGCT TCGTGAACTG AAACATCCAA ACATCGTTCG TTACTATGAT CGGATTATTG 360

ACCGGACCAA TACAACACTG TACATTGTAA TGGAATATTG TGAAGGAGGG GATGTGGCTA 420

GTGTAATTAC AAAGGGAACC AAGGAAAGGC AATACTTAGA TGAAGAGTTT GTTCTTCGAG 480

TGATGACTCA GTTGACTCTG GCCCTGAAGG AATGCCACAG ACGAAGTGAT GGTGGTGATA 540

CCGTATTGCA TCGGGATCTT AAACCAGCCA ATGTTTTCCT GGATGGCAAG CAAAACGTCA 600

AGCTTGGAGA CTTTGGGCTA GCTAGAATAT TAAACCATGA CACGAGTTTT GCAAAAACAT 660

TTGTTGGCAC ACCTTATTAC ATGTCTCCTG AACAAATGAA TCGCATGTCC TACAATGAGA 720
```

TABLE 20-continued

```
AATCAGATAT CTGGTCATTG GGCTGCTTGC TGTATGAGTT ATGTGCATTA ATGCCTCCAT  780

TTACAGCTTT TAGCCAGAAA GAACTCGCTG GGAAAATCAG AGAAGGCAAA TTCAGGCGAA  840

TTCCATACCG TTACTCTGAT GAATTGAATG AAATTATTAC GAGGATGTTA AACTTAAAGG  900

ATTACCATCG ACCTTCTGTT GAAGAAATTC TTGAGAACCC TTTAATAGCA GATTTGGTTG  960

CAGACGAGCA AAGAAGAAAT CTTGAGAGAA GAGGGCGACA ATTAGGAGAG CCAGAAAAAT 1020

CGCAGGATTC CAGCCCTGTA TTGAGTGAGC TGAAACTGAA GGAAATTCAG TTACAGGAGC 1080

GAGAGCGAGC TCTCAAAGCA AGAGAAGAAA GATTGGAGCA GAAAGAACAG GAGCTTTGTG 1140

TTCGTGAGAG ACTAGCAGAG GACAAACTGG CTAGAGCAGA AAATCTGTTG AAGAACTACA 1200

GCTTGCTAAA GGAACGGAAG TTCCTGTCTC TGGCAAGTAA TCCAGAACTT CTTAATCTTC 1260

CATCCTCAGT AATTAAGAAG AAAGTTCATT TCAGTGGGGA AAGTAAAGAG AACATCATGA 1320

GGAGTGAGAA TTCTGAGAGT CAGCTCACAT CTAAGTCCAA GTGCAAGGAC CTGAAGAAAA 1380

GGCTTCACGC TGCCCAGCTG CGGGCTCAAG CCCTGTCAGA TATTGAGAAA AATTACCAAC 1440

TGAAAAGCAG ACAGATCCTG GCATGCGCT AGCCAGGTAG AGAGACACAG AGCTGTGTAC 1500

AGGATGTAAT ATTACCAACC TTTAAAGACT GATATTCAAA TGCTGTACTG TTGAATACTT 1500

GGCCCCATGA GCCATGCCTT TCTGTATAGT ACACATGATA TTTCGGAATT GGTTTTACTG 1620

TTCTTCAGCA ACTATTGTAC AAAATGTTCA CATTTAATTT TTCTTTCTTC TTTTAAGAAC 1680

ATATTATAAA AAGAATACTT TCTTGGTTGG GCTTTTAATC CTGTGTGTGA TTACTAGTAG 1740

GAACATGAGA TGTGACATTC TAAATCTTGG GAGAAAAAAT AATATTAGGA AAAAAATATT 1600

TATGCAGGAA GAGTAGCACT CACTGAATAG TTTTAAATGA CTGAGTGGTA TGCTTACAAT 1860

TGTCATGTCT AGATTTAAAT TTTAAGTCTG AGATTTTAAA TGTTTTTGAG CTTAGAAAAC 1920

CCAGTTAGAT GCAATTTGGT CATTAATACC ATGACATCTT GCTTATAAAT ATTCCATTGC 1960

TCTGTAGTTC AAATCTGTTA GCTTTGTGAA AATTCATCAC TGTGATGTTT CTATTCTTTT 2040

TTTTTTTCTG TTTAACAGAA TATGAGCTGT CTGTCATTTA CCTACTTCTT TCCCACTAAA 2100

TAAAAGAATT CTTCAGTTA
```

SEQ ID NO: 30 Protein sequence:
Protein Accession #: NP_002488.1

```
1          11         21         31         41         51
|          |          |          |          |          |
MPSRAEDYEV LYTIGTGSYG RCQKIRRKSD GKILVWKELD YGSMTEAEKQ MLVSEVNLLR  60

ELKHPNIVRY YDRIIDRTNT TLYIVMEYCE GGDLASVITK GTKERQYLDE EFVLRVMTQL 120

TLALKECHRR SDGGHTVLHR DLKPANVFLD GKQNVKLGDF GLARILNHDT SFAKTFVGTP 180

YYMSPEQMNR MSYNEKSDIW SLGCLLYELC ALMPPFTAFS QKELAGKIRE GKFRRIPYRY 240

SDELNEIITR MLNLKDYHRP SVEEILENPL IAGLVADEQR RNLERRGRQL GEPEKSQDSS 300

PVLSELKLKE IQLQERERAL KAREERLEQK EQELCVRERL AEDKLARAEN LLKNYSLLKE 360

RKFLSLASNP ELLNLPSSVI KKKVHFSGES KENIMRSENS ESQLTSKSKC KDLKKRLHAA 420

QLRAQALSDI EKNYQLKSRQ ILGMR
```

SEQ ID NO: 31 DNA sequence
Nucleic Acid Accession #: NM_020242
Coding sequence: 72..4240

```
1          11         21         31         41         51
|          |          |          |          |          |
CAGTCGCGCG CGGTGCAGTC GGGAGGTGGA GGCACCGGCT GCATTGTTTT CGGGATCGAG  60

GGGTGAGGGC GCTATGGCAC CCGGCTGCAA AACTGAGTTA CGCAGCGTGA CAAATGGTCA 120

GTCTAACCAA CCAAGTAATG AAGGTGATGC CATCAAAGTT TTTGTGCGAA TTCGTCCTCC 180
```

TABLE 20-continued

```
TGCAGAAAGA TCTGGGTCAG CTGATGGAGA GCAGAACTTA TGCTTATCTG TGCTGTCCTC   240

CACGAGTCTC CGGCTGCACT CCAACCCTGA GCCCAAGACC TTCACGTTTG ATCATGTTGC   300

AGATGTGGAT ACCACTCAGG AATCTGTATT TGCAACTGTC GCTAAAAGCA TTGTGGAGTC   360

TTGCATGAGC GGTTATAATG GTACCATCTT TGCATATGGA CAGACTGGCT CAGGGAAGAC   420

ATTTACTATG ATGGGACCAT CTGAATCTGA TAATTTTTCT CATAACCTGA GGAGTAAT    480

CCCACGAAGT TTTGAATATT TGTTTTCCTT AATTGATCGT GAAAAGAAA AGGCTGGAGC   540

TGGAAAGAGT TTCCTTTGTA AGTGTTCCTT TATTGAAATC TACAACGAGC AGATATATGA   600

TCTACTGGAC TCTGCATCGG CTGGACTGTA CTTAAGGGAG CATATCAAGA AGGGAGTCTT   660

TGTTGTTGGT GCGGTGGAGC AGGTGGTAAC CTCAGCTGCT GAAGCCTATC AGGTGCTGTC   720

TGGAGGATGG AGGAATAGAC GTGTGGCATC AACATCAATG AACAGAGAAT CGTCTAGGTC   780

TCATGCCGTC TTTACAATTA CAATAGAGTC AATGGAGAAA AGTAATGAGA TTGTGAATAT   840

ACGGACCTCC CTACTCAACC TGGTGGATTT AGCAGGATCT GAAAGGCAAA AAGATACCCA   900

TGCAGAAGGG ATGAGATTGA AGGAAGCAGG TAACATAAAT CGATCATTGA GCTGCCTGGG   960

CCAAGTGATT ACAGCACTTG TCGACGTGGG TAATGGAAAA CAGAGACATG TTTGCTACAG  1020

AGACTCCAAA CTTACCTTCT TACTACGGGA TTCCCTTGGA GGTAATGCCA AAACAGCCAT  1080

AATTGCAAAT GTTCATCCTG GATCCAGGTG TTTTGGGGAA ACCCTATCAA CACTTAACTT  1140

TGCTCAAAGA GCCAAGCTGA TTAAAAACAA GGCAGTAGTA AATGAAGACA CCCAAGGAAA  1200

TGTGAGCCAG CTCCCGGCTG AAGTGAAGAG GCTCAAAGAA CAACTGGCGG AGCTTGCTTC  2260

AGGACAGACA CCACCAGAAA GCTTCCTGAC CAGAGACAAA AAGAAGACTA ACTATATGGA  1320

GTATTTCCAG GAAGCAATGT TATTCTTTAA GAAATCTGAA CAGGAAAAGA AGTCTCTGAT  1380

AGAAAAAGTT ACCCAATTAG AAGACCTCAC CCTCAAAAAG GAAAAATTTA TTCAATCTAA  1440

TAAAATGATT GTGAAATTCC GAGAGGATCA AATAATACGC TTGGAAAAGC TCCACAAGGA  1800

ATCCCGGGGA GGTTTTCTGC CTGAGGAGCA GGATCGTTTG CTCTCAGAAT TAAGGAATGA  1560

GATTCAAACT CTGCGAGAAC AAATAGAGCA CCACCCCAGA GTTGCAAAGT ATGCTATGGA  1620

AAATCATTCC CTCAGGGAGG AGAATAGAAG ACTGAGATTA TTAGAGCCTG TGAAAAGAGC  1680

TCAAGAAATG GATGCCCAGA CCATTGCAAA ACTAGAAAAA GCTTTCTCTG AAATAAGTGG  1740

CATGGAGAAA AGTGACAAAA ATCAGCAAGG ATTTTCACCT AAAGCTCAGA AAGAGCCATG  1800

TTTGTTTGCA AACACTGACA AGTTAAAAGC ACAACTCCTG CAAATTCAGA CAGAGCTGAA  1860

TAATTCAAAG CAAGAATATG AAGAATTCAA AGAACTTACT AGGAAAAGGC AGCTAGAATT  1920

GGAATCAGAG CTTCAGTCTT TGCAAAAAGC GAACCTTAAT CTTGAAAACC TTTTGGAAGC  1980

AACAAAAGCC TGCAAGCGGC AAGAAGTTTC TCAGCTGAAT AAAATTCATG CTGAAACACT  2040

TAAGATTATA ACTACACCAA CCAAGGCCTA CCAACTTCAT TCCCGACCAG TACCAAAATT  2100

AAGCCCTGAA ATGGGAAGCT TGGCTCTCT ATACACTCAG AATTCTAGCA TATTAGATAA  2160

TGATATATTA AATGAGCCAG TTCCTCCTGA GATGAATGAA CAAGCTTTTG AGGCCATTTC  2220

TGAAGAGCTT AGAACAGTGC AGGAACAAAT GAGTGCTCTT CAAGCCAAAC TGGATGAAGA  2280

AGAGCATAAA AACCTAAAGC TTCAGCAGCA TGTTGACAAA CTGGAACATC ATTCTACCCA  2340

AATGCAGGAG CTTTTCTCAT CAGAAAGAAT TGATTGGACC AAACAGCAGG AAGAGCTTCT  2400

CTCACAGTTG AATGTCCTTG AAAAGCAGCT TCAAGAGACT CAAACTAAAA ATGACTTTTT  2460

GAAAAGTGAG GTACATGACC TGCGAGTAGT CCTTCATTCT GCTGACAAGG AGCTTTCTTC  2520

AGTGAAATTG GAATATAGTT CATTCAAAAC GAATCAGGAG AAAGAATTCA ACAAACTTTC  2580
```

TABLE 20-continued

```
TGAAAGACAC ATGCATGTAC AGCTTCAATT AGATAATCTC AGGTTAGAAA ACGAAAAGCT  2640

GCTTGAGAGC AAAGCCTGCC TACAGGATTC CTATGACAAC TTACAAGAAA TAATGAAATT  2700

TGAGATTGAC CAACTTTCAA GAAACCTCCA AAACTTCAAA AAGAAAATG AAACTCTGAA   2760

ATCTGATCTG AATAATTTGA TGGAGCTTCT TGAGGCAGAA AAAGAACGCA ATAACAAATT  2820

ATCATTACAG TTTGAAGAAG ATAAAGAAAA CAGTTCTAAA GAAATCTTAA AAGTTCTTGA  2880

GGCTGTACGT CAGGAGAAAC AGAAAGAGAC GGCCAAGTGT GAGCAGCAGA TGGCAAAAGT  2940

ACAGAAACTA GAAGAGAGCT TGCTTGCTAC TGAAAAAGTG ATCAGTTCCC TGGAAAAGTC  3000

TAGAGATTCT GATAAGAAAG TTGTAGCTGA CCTCATGAAC CAGATCCAGG AGCTAAGAAC  3060

ATCGGTCTGT GAGAAAACAG AAACTATAGA CACCCTGAAA CAAGAACTGA AGGACATAAA  3120

TTGCAAATAC AACTCTGCTT TGGTTGACAG AGAAGAGAGC AGAGTGTTGA TCAAGAAGCA  3180

GGAAGTGGAT ATTCTGGATC TGAAAGAAAC CCTTAGGCTG AGAATACTTT CTGAGGACAT  3240

AGAGAGGGAT ATGCTCTGTG AGGACCTGGC TCATGCCACT GAGCAGCTGA ACATGCTCAC  3300

AGAGGCCTCA AAAAAACACT CGGGGCTGCT GCAGTCTGCC CAGGAAGAAC TGACCAAGAA  3360

GGAAGCCCTG ATTCAGGAAC TTCAGCACAA GCTAAACCAA AAGAAAGAGG AAGTAGAACA  3420

GAAGAAGAAT GAATATAACT TCAAAATGAG GCAACTAGAA CATGTGATGG ATTCTGCTGC  3480

TGAGGATCCC CAGAGTCCTA AGACACCACC TCACTTTCAA ACACATTTGG CAAAACTCCT  3540

GGAAACACAA GAACAAGAGA TAGAAGATGG AAGAGCCTCT AAGACTTCTT TGGAACACCT  3600

TGTAACAAAG CTAAATGAAG ACAGAGAAGT CAAAAATGCT GAAATCCTCA GAATGAAGGA  3660

GCAGTTGCGT GAAATGGAAA ACCTACGCCT GGAAAGTCAG CAGTTAATAG AGAAAAACTG  3720

GCTCCTGCAA GGTCAGCTGG ATGATATTAA AAGACAAAAG GAAAACAGTG ATCAGAATCA  3780

TCCAGATAAT CAACAGCTGA AGAATGAACA AGAAGAAAGT ATCAAAGAAA GACTTGCAAA  3840

AAGTAAAATA GTTGAAGAAA TGCTGAAAAT GAAAGCAGAC CTAGAAGAAG TCCAAAGTGC  3900

CCTTTACAAC AAAGAGATGG AATGCCTTAG AATGACTGAT GAAGTCGAAC GAACCCAAAC  3960

TTTGGAGTCT AAAGCATTCC AGGAAAAAGA ACAACTGAGA TCAAAGCTCG AAGAAATGTA  4020

TGAAGAAAGA GAGAGAACAT CCCAGGAGAT GGAAATGTTA AGGAAGCAGG TGGAGTGTCT  4080

TGCTGAGGAA AATGGAAAGT TGGTAGGTCA CCAAAATTTG CATCAGAAGA TTCAGTACGT  4140

AGTGCGACTA AAGAAGGAAA ATGTCAGGCT TGCTGAGGAG ACAGAAAAGT TGCGTGCCGA  4200

AAATGTATTT TTAAAAGAAA AGAAAAGAAG TGAATCTTGA GGATTCCGGT CAGCTACCTA  4260

GGCATCACCT TGTTTGAACA TGTTTCTTCT CTTTTACAAG TAAGACCTAC TCCTGGCCAC  4320

TTAGGAGAGC TGAATTTATG GACCTTAATT ATTAAATGTT TATAAGGTGG TGGTAACCAC  4380

CTCAAGTTTC TGATGAACAT TCTGCATCCA TATACACCCT GTGACAGTCA GCAGTCTGCT  4440

ATTAAGTGGC CTACTTCAAG GCTTTGAATC AACTTAAGGG AAAACCTTTT GTCTTTGTAA  4500

AAATAAAAGC CTGTAGCTAA GGTTTACAGT GGACATTAGC CAGATCATTT TCTTCTTAGA  4560

TTATGCCATA ATCTCCTTTG ATTCTTATGG AAGTTCTAAC AATATATGGT GGTTCCAACA  4620

CCTGCAGTGA GTTAATGAC TGACTTAGTA GCAGGTACAA GAAGCAAACT TGTTAATATA   4680

GATTATTTTT GTATTCTTAC TTTAGGTATT TTACTTGAGC ATTTTCCATG ACTGTAAATA  4740

AAGCCATTTT TTAAGATAAA AAAAAAAAAA AAAAA
```

TABLE 20-continued

SEQ ID NO. 32 Protein sequence
Protein Accession #: NP_064627

```
1          11         21         31         41         51
|          |          |          |          |          |
MAPGCKTELR SVTNGQSNQP SNEGDAIKVF VRIRPPAERS GSADGEQNLC LSVLSSTSLR  60
LHSNPEPKTF TFDHVADVDT TQESVFATVA KSIVESCMSG YNGTIFAYGQ TGSGKTFTMM 120
GPSESDNFSH NLRGVIPRSF EYLFSLIDRE KEKAGAGKSF LCKCSFIEIY NEQIYDLLDS 180
ASAGLYLREH IKKGVFVVGA VEQVVTSAAE AYQVLSGGWR NRRVASTSMN RESSRSHAVF 240
TITIESMEKS NEIVNIRTSL LNLVDLAGSE RQKDTHAEGM RLKEAGNINR SLSCLGQVIT 300
ALVDVGNGKQ RHVCYRDSKL TFLLRDSLGG NAKTAIIANV HPGSRCFGET LSTLNFAQRA 360
KLIKNKAVVN EDTQGNVSQL QAEVKRLKEQ LAELASGQTP PESFLTRDKK KTNYMEYFQE 420
AMLFFKKSEQ EKKSLIEKVT QLEDLTLKKE KFIQSNKMIV KFREDQIIRL EKLHKESRGG 480
FLPEEQDRLL SELRNEIQTL REQIEHHPRV AKYAMENHSL REENRELRLL EPVKRAQEMD 540
AQTIAKLEKA FSEISGMEKS DKNQQGFSPK AQKEPCLFAN TEKLKAQLLQ IQTELNNSKQ 600
EYEEFKELTR KRQLELESEL QSLQKANLNL ENLLEATKAC KRQEVSQLNK IHAETLKIIT 660
TPTKAYQLHS RPVPKLSPEM GSFGSLYTQN SSILDNDILN EPVPPEMNEQ AFEAISEELR 720
TVQEQMSALQ AKLDEEEHKN LKLQQHVDKL EHHSTQMQEL FSSERIDWTK QQEELLSQLN 780
VLEKQLQETQ TKNDFLKSEV HDLRVVLHSA DKELSSVKLE YSSFKTNQEK EFNKLSERHM 840
HVQLQLDNLR LENEKLLESK ACLQDSYDNL QEIMKFEIDQ LSRNLQNPKK ENETLKSDLN 900
NLMELLEAEK ERNNKLSLQF EEDKENSSKE ILKVLEAVRQ ESQKETAKCE QQMAKVQKLE 960
ESLLATEKVI SSLEKSRDSD KKVVADLMNQ IQELRTSVCE KTETIDTLKQ ELKDINCKYN 1020
SALVDREESR VLIKKQEVDI LDLKETLRLR ILSEDIERDM LCEDLAHATE QLNMLTEASK 1080
KHSGLLQSAQ EELTKKEALI QELQHKLNQK KEEVEQKKNE YNFKMRQLEH VMDSAAEDPQ 1140
SPKTPPHFQT HLAKLLETQE QEIEDGRASK TSLEHLVTKL NEDREVKNAE ILRMKEQLRE 1200
MENLRLESQQ LIEKNWLLQG QLDDIKRQKE NSDQNHPDNQ QLKNEQEESI KERLAKSKIV 1260
EEMLKMKADL EEVQSALYNK EMECLRMTDE VERTQTLESK AFQEKEQLRS KLEEMYEERE 1320
RTSQEMEMLR KQVECLAEEN GKLVGHQNLH QKIQYVVRLK KENVRLAEET EKLRAENVFL 1380
KEKKRSES
```

SEQ ID NO. 33 DNA sequence
Nucleic Acid Accession 8: BC000633.1
Coding sequence: 1. .2574

```
1          11         21         31         41         51
|          |          |          |          |          |
ATGGAATCCG AGGATTTAAG TGGCAGAGAA TTGACAATTG ATTCCATAAT GAACAAAGTG  60
AGAGACATTA AAAATAAGTT TAAAAATGAA GACCTTACTG ATGAACTAAG CTTGAATAAA 120
ATTTCTGCTG ATACTACAGA TAACTCGGGA ACTGTTAACC AAATTATGAT GATGGCAAAC 180
AACCCAGAGG ACTGGTTGAG TTTGTTGCTC AAACTAGAGA AAAACAGTGT TCCGCTAAGT 240
GATGCTCTTT TAAATAAATT GATTGGTCGT TACAGTCAAG CAATTGAAGC GCTTCCCCCA 300
GATAAATATG CCAAAATGA GAGTTTTGCT AGAATTCAAG TGAGATTTGC TGAATTAAAA 360
GCTATTCAAG AGCCAGATGA TGCACGTGAC TACTTTCAAA TGGCCAGAGC AAACTGCAAG 420
AAATTTGCTT TTGTTCATAT ATCTTTTGCA CAATTTGAAC TGTCACAAGG TAATGTCAAA 480
AAAGTAAAC AACTTCTTCA AAAAGCTGTA GAACGTGGAG CAGTACCACT AGAAATGCTG 540
GAAATTGCCC TGCGGAATTT AAACCTCCAA AAAAAGCAGC TGCTTTCAGA GGAGGAAAAG 600
AAGAATTTAT CAGCATCTAC GGTATTAACT GCCCAAGAAT CATTTTCCGG TTCACTTGGG 660
```

TABLE 20-continued

```
CATTTACAGA ATAGGAACAA CAGTTGTGAT TCCAGAGGAC AGACTACTAA AGCCAGGTTT  720

TTATATGGAG AGAACATGCC ACCACAAGAT GCAGAAATAG GTTACCGGAA TTCATTGAGA  780

CAAACTAACA AAACTAAACA GTCATGCCCA TTTGGAAGAG TCCCAGTTAA CCTTCTAAAT  840

AGCCCAGATT GTGATGTGAA GACAGATGAT TCAGTTGTAC CTTGTTTTAT GAAAAGACAA  900

ACCTCTAGAT CAGAATGCCG AGATTTGGTT GTGCCTGGAT CTAAACCAAG TGGAAATGAT  960

TCCTGTGAAT TAAGAAATTT AAAGTCTGTT CAAAATAGTC ATTTCAAGGA ACCTCTGGTG 1020

TCAGATGAAA AGAGTTCTGA ACTTATTATT ACTGATTCAA TAACCCTGAA GAATAAAACG 1080

GAATCAAGTC TTCTAGCTAA ATTAGAAGAA ACTAAAGAGT ATCAAGAACC AGAGGTTCCA 1140

GAGAGTAACC AGAAACAGTG GCAATCTAAG AGAAAGTCAG AGTGTATTAA CCAGAATCCT 1200

GCTGCATCTT CAAATCACTG GCAGATTCCG GAGTTAGCCC GAAAAGTTAA TACAGAGCAG 1260

AAACATACCA CTTTTGAGCA ACCTGTCTTT TCAGTTTCAA AACAGTCACC ACCAATATCA 1320

ACATCTAAAT GGTTTGACCC AAAATCTATT TGTAAGACAC AAGCAGCAA TACCTTGGAT 1380

GATTACATGA GCTGTTTTAG AACTCCAGTT GTAAAGAATG ACTTTCCACC TGCTTGTCAG 1440

TTGTCAACAC CTTATGGCCA ACCTGCCTGT TTCCAGCAGC AACAGCATCA ATACTTGCC  1500

ACTCCACTTC AAAATTTACA GGTTTTAGCA TCTTCTTCAG CAAATGAATG CATTTCGGTT 1560

AAAGGAAGAA TTTATTCCAT TTTAAAGCAG ATAGGAAGTG GAGGTTCAAG CAAGGTATTT 1620

CAGGTGTTAA ATGAAAAGAA ACAGATATAT GCTATAAAAT ATGTGAACTT AGAAGAAGCA 1680

GATAACCAAA CTCTTGATAG TTACCGGAAC GAAATAGCTT ATTTGAATAA ACTACAACAA 1740

CACAGTGATA AGATCATCCG ACTTTATGAT TATGAAATCA CGGACCACTA CATCTACATG 1800

GTAATGGAGT GTGAAATAT TGATCTTAAT AGTTGGCTTA AAAAGAAAAA ATCCATTGAT 1860

CCATGGGAAC GCAAGAGTTA CTGGAAAAAT ATGTTAGAGG CAGTTCACAC AATCCATCAA 1920

CATGGCATTG TTCACAGTGA TCTTAAACCA GCTAACTTTC TGATAGTTGA TGGAATGCTA 1980

AAGCTAATTG ATTTTGGGAT TGCAAACCAA ATGCAACCAG ATACAACAAG TGTTGTTAAA 2040

GATTCTCAGG TTGGCACAGT TAATTATATG CCACCAGAAG CAATCAAAGA TATGTCTTCC 2100

TCCAGAGAGA ATGGGAAATC TAAGTCAAAG ATAAGCCCCA AAAGTGATGT TGGTCCTTA  2160

GGATGTATTT TGTACTATAT GACTTACGGG AAAACACCAT TTCAGCAGAT AATTAATCAG 2220

ATTTCTAAAT TACATGCCAT AATTGATCCT AATCATGAAA TTGAATTTCC CGATATTCCA 2280

GAGAAAGATC TTCAAGATGT GTTAAAGTGT TGTTTAAAAA GGGACCCAAA ACAGAGGATA 2340

TCCATTCCTG AGCTCCTGGC TCATCCCTAT GTTCAAATTC AAACTCATCC AGTTAACCAA 2400

ATGGCCAAGG GAACCACTGA AGAAATGAAA TATGTTCTGG GCCAACTTGT TGGTCTGAAT 2460

TCTCCTAACT CCATTTTGAA AGCTGCTAAA ACTTTATATG AACACTATAG TGGTGGTGAA 2520

AGTCATAATT CTTCATCCTC CAAGACTTTT GAAAAAAAAA GGGGGAAAAA ATGA
```

SEQ ID NO: 34 Protein sequence
Protein Accession #: AAH00633.1

```
1          11         21         31         41         51
|          |          |          |          |          |
MESEDLSGRE LTIDSIMNKV RDIKNKFKNE DLTDELSLNK ISADTTDNSG TVNQIMMMAN  60

NPEDWLSLLL KLEKNSVPLS DALLNKLIGR YSQAIEALPP DKYGQNESFA RIQVRFAELK 120

AIQEPDDARD YFQMARANCK KFAFVHISFA QFELSQGNVK KSKQLLQKAV ERGAVPLEML 180

EIALRNLNLQ KKQLLSEEEK KNLSASTVLT AQESFSGSLG HLQNRNNSCD SRGQTTKARF 240

LYGENMPPQD AEIGYRNSLR QTNKTKQSCP FGRVPVNLLN SPDCDVKTDD SVVPCFMKRQ 300

TSRSECRDLV VPGSKPSGND SCELRNLKSV QNSHFKEPLV SDEKSSELII TDSITLKNET 360
```

TABLE 20-continued

```
ESSLLAKLEE TKEYQEPEVP ESNQKQWQSK RKSECINQNP AASSNHWQIP ELARKVNTEQ   420

KHTTFEQPVF SVSKQSPPIS TSKWFDPKSI CKTPSSNTLD DYMSCFRTPV VKNDFPPACQ   480

LSTPYGQPAC FQQQQHQILA TPLQNLQVLA SSSANECISV KGRIYSILKQ IGSGGSSKVF   540

QVLNEKKQIY AIKYVNLEEA DNQTLDSYRN EIAYLNKLQQ HSDKIIRLYD YEITDQYIYM   600

VMECGNIDLN SWLKKKKSID PWERKSYWKN MLEAVNTIHQ HGIVHSDLKP ANFLIVDGML   660

KLIDFGIANQ MQPDTTSVVK DSQVGTVNYM PPEAIKDMSS SRENGKSKSK ISPKSDVWSL   720

GCILYYMTYG KTPFQQIINQ ISKLHAIIDP NHEIEFPDIP EKDLQDVLKC CLKRDPKQRI   780

SIPELLAHPY VQIQTHPVNQ MAKGTTEEMK YVLGQLVGLN SPNSILKAAK TLYEHYSGGE   840

SNNSSSSKTF EKKRGKK

SEQ ID NO. 35 DNA sequence
Nucleic Acid Accession #: NM_005823.2
Coding sequence: 85. .1953
1          11         21         31         41         51
|          |          |          |          |          |
TGGCCACTCC CGTCTGCTGT GACGCGCGGA CAGAGAGCTA CCGGTGGACC CACGGTGCCT   60

CCCTCCCTGG GATCTACACA GACCATGGCC TTGCCAACGG CTCGACCCCT GTTGGGGTCC   120

TGTGGGACCC CCGCCCTCGG CAGCCTCCTG TTCCTGCTCT TCAGCCTCGG ATGGGTGCAG   180

CCCTCGAGGA CCCTGGCTGG AGAGACAGGG CAGGAGGCTG CACCCCTGGA CGGAGTCCTG   240

GCCAACCCAC CTAACATTTC CAGCCTCTCC CCTCGCCAAC TCCTTGGCTT CCCGTGTGCG   300

GAGGTGTCCG GCCTGAGCAC GGAGCGTGTC CGGGAGCTGG CTGTGGCCTT GGCACAGAAG   360

AATGTCAAGC TCTCAACAGA GCAGCTGCGC TGTCTGGCTC ACCGGCTCTC TGAGCCCCCC   420

GAGGACCTGG ACGCCCTCCC ATTGGACCTG CTGCTATTCC TCAACCCAGA TGCGTTCTCG   480

GGGCCCCAGG CCTGCACCCG TTTCTTCTCC CGCATCACGA AGGCCAATGT GGACCTGCTC   540

CCGAGGGGGG CTCCCGAGCG ACAGCGGCTG CTGCCTGCGG CTCTGGCCTG CTGGGGTGTG   600

CGGGGGTCTC TGCTGAGCGA GGCTGATGTG CGGGCTCTGG GAGGCCTGGC TTGCGACCTG   660

CCTGGGCGCT TTGTGGGCGA GTCGGCCGAA GTGCTGCTAC CCCGGCTGGT GAGCTGCCCG   720

GGACCCCTGG ACCAGGACCA GCAGGAGGCA GCCAGGGCGG CTCTGCAGGG CGGGGGACCC   780

CCCTACGGCC CCCCGTCGAC ATGGTCTGTC TCCACGATGG ACGCTCTGCG GGGCCTGCTG   840

CCCGTGCTGG GCCAGCCCAT CATCCGCAGC ATCCCGCAGG GCATCGTGGC CGCGTGGCGG   900

CAACGCTCCT CTCGGGACCC ATCCTGGCGG CAGCCTGAAC GGACCATCCT CCGGCCGCGG   960

TTCCGGCGGG AAGTGGAGAA GACAGCCTGT CCTTCAGGCA AGAAGGCCCG CGAGATAGAC   1020

GAGAGCCTCA TCTTCTACAA GAAGTGGGAG CTGGAAGCCT GCGTGGATGC GGCCCTGCTG   2080

GCCACCCAGA TGGACCGCGT GAACGCCATC CCCTTCACCT ACGAGCAGCT GGACGTCCTA   1140

AAGCATAAAC TGGATGAGCT CTACCCACAA GGTTACCCCG AGTCTGTGAT CCAGCACCTG   1200

GGCTACCTCT TCCTCAAGAT GAGCCCTGAG GACATTCGCA AGTGGAATGT GACGTCCCTG   1260

GAGACCCTGA AGGCTTTGCT TGAAGTCAAC AAAGGGCACG AAATGAGTCC TCAGGTGGCC   1320

ACCCTGATCG ACCGCTTTGT GAAGGGAAGG GGCCAGCTAG ACAAAGACAC CCTAGACACC   1380

CTGACCGCCT TCTACCCTGG GTACCTGTGC TCCCTCAGCC CGAGGAGCT GAGCTCCGTG   1440

CCCCCCAGCA GCATCTGGGC GGTCAGGCCC CAGGACCTGG ACACGTGTGA CCCAAGGCAG   1500

CTGGACGTCC TCTATCCCAA GGCCCGCCTT GCTTTCCAGA ACATGAACGG TCCGAATAC    1560

TTCGTGAAGA TCCAGTCCTT CCTGGGTGGG CCCCCACGG AGGATTTGAA GGCGCTCAGT   1620

CAGCAGAATG TGAGCATGGA CTTGGCCACG TTCATGAAGC TGCGGACGGA TGCGGTGCTG   1080
```

TABLE 20-continued

```
CCGTTGACTG TGGCTGAGGT GCAGAAACTT CTGGGACCCC ACGTGGAGGG CCTGAAGGCG  1740

GAGGAGCGGC ACCGCCCGGT GCGGGACTGG ATCCTACCGC ACCGGCAGGA CGACCTGGAC  1800

ACGCTGGGGC TGGGGCTACA GGGCGGCATC CCCAACGGCT ACCTGGTCCT AGACCTCAGC  1860

GTGCAAGAGG CCCTCTCGGG GACGCCCTGC CTCCTAGGAC CTGGACCTGT TCTCACCGTC  1920

CTGGCACTGC TCCTAGCCTC CACCCTGGCC TGAGGGCCCC ACTCCCTTGC TGGCCCCAGC  1980

CCTGCTGGGG ATCCCCGCCT GGCCAGGAGC AGGCACGGGT GATCCCCGTT CCACCCCAAG  2040

AGAACTCGCG CTCAGTAAAC GGGAACATGC CCCCTGCAGA CACGT

SEQ ID NO: 36 Protein sequence
Protein Accession #: NP_005814.1
1          11         21         31         41         51
|          |          |          |          |          |
MALPTARPLL GSCGTPALGS LLFLLFSLGW VQPSRTLAGE TGQEAAPLDG VLANPPNISS  60

LSPRQLLGFP CAEVSGLSTE RVRELAVALA QKNVKLSTEQ LRCLAHRLSE PPEDLDALPL  120

DLLLFLNPDA FSGPQACTRF FSRITKANVD LLPRGAPERQ RLLPAALACW GVRGSLLSEA  180

DVRALGGLAC DLPGRFVAES AEVLLPRLVS CPGPLDQDQQ EAARAALQGG GPPYGPPSTW  240

SVSTMDALRG LLPVLGQPII RSIPQGIVAA WRQRSSRDPS WRQPERTILR PRFRREVEKT  300

ACPSGKKARE IDESLIFYKK WELEACVDAA LLATQMDRVN AIPFTYEQLD VLKHKLDELY  360

PQGYPESVIQ HLGYLFLKMS PEDIRKWNVT SLETLKALLE VNKGHEMSPQ VATLIDRFVK  420

GRGQLDKDTL DTLTAFYPGY LCSLSPEELS SVPPSSIWAV RPQDLDTCDP RQLDVLYPKA  480

RLAFQNMNGS EYFVKIQSFL GGAPTEDLKA LSQQNVSMDL ATFMKLRTDA VLPLTVAEVQ  540

KLLGPNVEGL KAEERHRPVR DWILRQRQDD LDTLGLGLQG GIPNGYLVLD LSVQEALSGT  600

PCLLGPGPVL TVLALLLAST LA

SEQ ID NO: 37 DNA sequence
Nucleic Acid Accession #: NM_013404.1
Coding sequence: 89. .1975
1          11         21         31         41         51
|          |          |          |          |          |
TGGCCGGCCA CTCCCGTCTG CTGTGACGCG CGGACAGAGA GCTACCGGTG GACCCACGGT  60

GCCTCCCTCC CTGGGATCTA CACAGACCAT GGCCTTGCAA CGGCTCGACC CCTGTTGGTC  120

CTGTGGGGAC CGCCCTGGCA GCCTCCTGTT CCTGCTCTTC AGCCTCGGAT GGGTGCATCC  180

CGCGAGGACC CTGGCTGGAG AGACAGGGAC GGAGTCTGCC CCCCTGGGGG GAGTCCTGAC  240

AACCCCCCAT AACATTTCCA GCCTCTCCCC TCGCCAACTC CTTGGCTTCC CGTGTGCGGA  300

GGTGTCCGGC CTGAGCACGG AGCGTGTCCG GGAGCTGGCT GTGGCCTTGG CACAGAAGAA  360

TGTCAAGCTC TCAACAGAGC AGCTGCGCTG TCTGGCTCAC CGGCTCTCTG AGCCCCCCGA  420

GGACCTGGAC GCCCTCCCAT GGACCTGCT GCTATTCCTC AACCCAGATG CGTTCTCGGG  480

GCCCCAGGCC TGCACCCGTT TCTTCTCCCG CATCACGAAG GCCAATGTGG ACCTGCTCCC  540

GAGGGGGGCT CCCGAGCGAC AGCGGCTGCT GCCTGCGGCT CTGGCCTGCT GGGGTGTGCG  600

GGGGTCTCTG CTGAGCGAGG CTGATGTGCG GGCTCTGGGA GGCCTGGCTT GCGACCTGCC  660

TGGGCGCTTT GTGGCCGAGT CGGCCGAAGT GCTGCTACCC CGGCTGGTGA GCTGCCCGGG  720

ACCCCTGGAC CAGGACCAGC AGGAGGCAGC CAGGGCGGCT CTGCAGGGCG GGGACCCCC  780

CTACGGCCCC CCGTCGACAT GGTCTGTCTC CACGATGGAC GCTCTGCGGG GCCTGCTGCC  840

CGTGCTGGGC CAGCCCATCA TCCGCAGCAT CCCGCAGGGC ATCGTGGCCG CGTGGCGGCA  900

ACGCTCCTCT CGGGACCCAT CCTGGCGGCA GCCTGAACGG ACCATCCTCC GGCCGCGGTT  960

CCGGCGGGAA GTGGAGAAGA CAGCCTGTCC TTCAGGCAAG AAGGCCCGCG AGATAGACGA  1020
```

TABLE 20-continued

```
GAGCCTCATC TTCTACAAGA AGTGGGAGCT GGAAGCCTGC GTGGATGCGG CCCTGCTGGC   1080

CACCCAGATG GACCGCGTGA ACGCCATCCC CTTCACCTAC GAGCAGCTGG ACGTCCTAAA   1140

GCATAAACTG GATGAGCTCT ACCCACAAGG TTACCCCGAG TCTGTGATCC AGCACCTGGG   1200

CTACCTCTTC CTCAAGATGA GCCCTGAGGA CATTCGCAAG TGGAATGTGA CGTCCCTGGA   1260

GACCCTGAAG GCTTTGCTTG AAGTCGACAA AGGGCACGAA ATGAGTCCTC AGGCTCCTCG   1320

GCGGCCCCTC CCACAGGTGG CCACCCTGAT CGACCGCTTT GTGAAGGGAA GGGGCCAGCT   1380

AGACAAAGAC ACCCTAGACA CCCTGACCGC CTTCTACCCT GGGTACCTGT GCTCCCTCAG   1440

CCCCCAGGAG CTGAGCTCCG TGCCCCCCAG CAGCATCTGG GCGGTCAGGC CCAGGACCT    1500

GGACACGTGT GACCCAAGGC AGCTGGACGT CCTCTATCCC AAGGCCCGCC TTGCTTTCCA   1560

GAACATGAAC GGGTCCGAAT ACTTCGTGAA GATCCAGTCC TTCCTGGGTG GGGCCCCCAC   1020

GGAGGATTTG AAGGCGCTCA GTCAGCAGAA TGTGAGCATG GACTTGGCCA CGTTCATGAA   1680

GCTGCGGACG GATGCCGTGC TGCCGTTGAC TGTGGCTGAG GTGCAGAAAC TTCTGGGACC   1740

CCACGTGGAG GGCCTGAAGG CGGAGGAGCG GCACCGCCCG GTGCGGGACT GGATCCTACG   1800

GCAGCGGCAG GACGACCTGG ACACGCTGGG GCTGGGGCTA CAGGGGGGCA TCCCCAACGG   1860

CTACCTGGTC CTAGACCTCA GCGTGCAAGA GACCCTCTCG GGACGCCCT  GCCTCCTAGG   1920

ACCTGGACCT GTTCTCACCG TCCTGGCACT GCTCCTAGCC TCCACCCTGG CCTGAGGGCC   1960

CCACTCCCTT GCTGGCCCCA GCCCTGCTGG GGATCCCCGC CTGGCCAGGA GCAGGCACGG   2040

GTGATCCCCG TTCCACCCCA AGAGAACTCG CGCTCAGTAA ACGGGAACAT GCCCCCTGCA   2100

GACACGT
```

SEQ ID NO. 38 Protein sequence
Protein Accession #. NP_037536.1

```
1          11         21         31         41         51
|          |          |          |          |          |
MALQRLDPCW SCGDRPGSLL FLLFSLGWVH PARTLAGETG TESAPLGGVL TTPHNISSLS   60

PRQLLGFPCA EVSGLSTERV RELAVALAQK NVKLSTEQLR CLAHRLSEPP EDLDALPLDL   120

LLFLNPDAFS GPQACTRFFS RITKANVDLL PRGAPERQRL LPAALACWGV RGSLLSEADV   180

RALGGLACDL PGRFVAESAE VLLPRLVSCP GPLDQDQQEA ARAALQGGGP PYGPPSTWSV   240

STMDALRGLL PVLGQPIIRS IPQGIVAAWR QRSSRDPSWR QPERTILRPR FRREVEKTAC   300

PSGKKAREID ESLIFYKKWE LEACVDAALL ATQMDRVNAI PFTYEQLDVL KHKLDELYPQ   360

GYPESVIQHL GYLFLKMSPE DIRKWNVTSL ETLKALLEVD KGHEMSPQAP RRPLPQVATL   420

IDRFVKGRGQ LDKDTLDTLT AFYPGYLCSL SPEELSSVPP SSIWAVRPQD LDTCDPRQLD   480

VLYPKARLAF QNMNGSEYFV KIQSFLGGAP TEDLKALSQQ NVSMDLATFM KLRTDAVLPL   540

TVAEVQKLLG PHVEGLKAEE RHRPVRDWIL RQRQDDLDTL GLGLQGGIPN GYLVLDLSVQ   600

ETLSGTPCLL GPGPVLTVLA LLLASTLA
```

SEQ ID NO. 39 DNA sequence
Nucleic Acid Accession #: NN_001508.1
Coding sequence: 1..1362

```
1          11         21         31         41         51
|          |          |          |          |          |
ATGGCTTCAC CCAGCCTCCC GGGCAGTGAC TGCTCCCAAA TCATTGATCA CAGTCATGTC   60

CCCGAGTTTG AGGTGGCCAC CTGGATCAAA ATCACCCTTA TTCTGGTGTA CCTGATCATC   120

TTCGTGATGG GCCTTCTGGG GAACAGCGTC ACCATTCGGG TCACCCAGGT GCTGCAGAAG   180

AAAGGATACT TGCAGAAGGA GGTGACAGAC CACATGGTGA GTTTGGCTTG CTCGGACATC   240

TTGGTGTTCC TCATCGGCAT GCCCATGGAG TTCTACAGCA TCATCTGGAA TCCCCTGACC   300
```

TABLE 20-continued

```
ACGTCCAGCT ACACCCTGTC CTGCAAGCTG CACACTTTCC TCTTCGAGGC CTGCAGCTAC  360

GCTACGCTGC TGCACGTGCT GACGCTCAGC TTTGAGCGCT ACATCGCCAT CTGTCACCCC  420

TTCAGGTACA AGGCTGTGTC GGGACCTTGC CAGGTGAAGC TGCTGATTGG CTTCGTCTGG  480

GTCACCTCCG CCCTGGTGGC ACTGCCCTTG CTGTTTGCCA TGGGTACTGA GTACCCCCTG  540

GTGAACGTGC CCAGCCACCG GGGTCTCACT TGCAACCGCT CCAGCACCCG CCACCACGAG  600

CAGCCCGAGA CCTCCAATAT GTCCATCTGT ACCAACCTCT CCAGCCGCTG GACCGTGTTC  660

CAGTCCAGCA TCTTCGGCGC CTTCGTGGTC TACCTCGTGG TCCTGCTCTC CGTAGCCTTC  720

ATGTGCTGGA ACATGATGCA GGTGCTCATG AAAAGCCAGA AGGGCTCGCT GGCCGGGGGC  780

ACGCGGCCTC CGCAGCTGAG GAAGTCCGAG AGCGAAGAGA GCAGGACCGC CAGGAGGCAG  840

ACCATCATCT TCCTGAGGCT GATTGTTGTG ACATTGGCCG TATGCTGGAT GCCCAACCAG  900

ATTCGGAGGA TCATGGCTGC GGCCAAACCC AAGCACGACT GGACGAGGTC CTACTTCCGG  960

GCGTACATGA TCCTCCTCCC CTTCTCGGAG ACGTTTTTCT ACCTCAGCTC GGTCATCAAC 1020

CCGCTCCTGT ACACGGTGTC CTCGCAGCAG TTTCGGCGGG TGTTCGTGCA GGTGCTGTGC 1080

TGCCGCCTGT CGCTGCAGCA CGCCAACCAC GAGAAGCGCC TGCGCGTACA TGCGCACTCC 1140

ACCACCGACA GCGCCCGCTT TGTGCAGCGC CCGTTGCTCT TCGCGTCCCG GCGCCAGTCC 1200

TCTGCAAGGA GAACTGAGAA GATTTTCTTA AGCACTTTTC AGAGCGAGGC CGAGCCCCAG 1260

TCTAAGTCCC AGTCATTGAG TCTCGAGTCA CTAGAGCCCA ACTCAGGCGC GAAACCAGCC 1320

AATTCTGCTG CAGAGAATGG TTTTCAGGAG CATGAAGTTT GA
```

SEQ ID NO: 40 Protein sequence
Protein Accession #: NP_001499.1
```
1          11         21         31         41         51
|          |          |          |          |          |
MASPSLPGSD CSQIIDNSHV PEFEVATWIK ITLILVYLII FVMGLLGNSV TIRVTQVLQK  60

KGYLQKEVTD HMVSLACSDI LVFLIGMPME FYSIIWNPLT TSSYTLSCKL HTFLFEACSY 120

ATLLHVLTLS FERYIAICHP FRYKAVSGPC QVKLLIGFVW VTSALVALPL LFANGTEYPL 180

VNVPSHRGLT CNRSSTRHHE QPETSNMSIC TNLSSRWTVF QSSIFGAFVV YLVVLLSVAF 240

MCWNMMQVLM KSQKGSLAGG TRPPQLRKSE SEESRTARRQ TIIFLRLIVV TLAVCWMPNQ 300

IRRIMAAAKP KHDWTRSYFR AYMILLPFSE TFFYLSSVIN PLLYTVSSQQ FRRVFVQVLC 360

CRLSLQHANH EKRLRVHAHS TTDSARFVQR PLLFASRRQS SARRTEKIFL STFQSEAEPQ 420

SKSQSLSLES LEPNSGAKPA NSAAENGFQE HEV
```

SEQ ID NO: 41 DNA sequence
Nucleic Acid Accession #: NM_022358
Coding sequence: 65..1057
```
1          11         21         31         41         51
|          |          |          |          |          |
GGAGCGCGCG GTCCGGGCAC ACGGAGCAGG TTGGGACCGC GGCGGGTACC GGGGCCGGGG  60

CCCCATGCGG AGGCCGAGCG TGCGCGCGGC CGGGCTGGTC CTGTGCACCC TGTGTTACCT 120

GCTGGTGGGC GCTGCTGTCT TCGACGCGCT CGAGTCCGAG GCGGAAAGCG GCCGCCAGCG 180

ACTGCTGGTC CAGAAGCGGG GCGCTCTCCG GAGGAACTTC GGCTTCTCGG CCGAGGACTA 240

CCGCGAGCTG GAGCGCCTGG CGCTCCAGGC TGAGCCCCAC CGCGCCGGCC GCCAGTGGAA 300

GTTCCCCGGC TCCTTCTACT CGCCATCAC CGTCATCACT ACCATCGGGT ACGGCCACGC 360

CGCGCCGGGT ACGGACTCCG GCAAGGTCTT CTGCATGTTC TACGCGCTCC TGGGCATCCC 420

GCTGACGCTG GTCACTTTCC AGAGCCTGGG CGAACGGCTG AACGCGGTGG TGCGGCGCCT 480

CCTGTTGGCG GCCAAGTGCT GCCTGGGCCT GCGGTGGACG TGCGTGTCCA CGGAGAACCT 540
```

TABLE 20-continued

```
GGTGGTGGCC GGGCTGCTGG CGTGTGCCGC CACCCTGGCC CTCGGGGCCG TCGCCTTCTC   600

GCACTTCGAG GGCTGGACCT TCTTCCACGC CTACTACTAC TGCTTCATCA CCCTCACCAC   660

CATCGGCTTC GGCGACTTCG TGGCACTGCA GAGCGGCGAG GCGCTGCAGA GGAAGCTCCC   720

CTACGTGGCC TTCAGCTTCC TCTACATCCT CCTGGGGCTC ACGGTCATTG GCGCCTTCCT   780

CAACCTGGTG GTCCTGCGCT TCCTCGTTGC CAGCGCCGAC TGGCCCGAGC GCGCTGCCCG   840

CCCCCCCAGC CCGCGCCCCC CGGGGGCGCC CGAGAGCCGT GGCCTCTGGC TGCCCCGCCG   900

CCCGGCCCGC TCCGTGGGCT CCGCCTCTGT CTTCTGCCAC GTGCACAAGC TGGAGAGGTG   960

CGCCCGCGAC AACCTGGGCT TTTCGCCCCC CTCGAGCCCG GGGGTCGTGC GTGGCGGGCA  1020

GGCTCCCAGG CCTGGGGCCC GGTGGAAGTC CATCTGACAA CCCCACCCAG GCCAGGGTCG  1080

AATCTGGAAT GGGAGGGTCT GGCTTCAGCT ATCAGGGCAC CCTCCCCAGG GATTGGAAAC  1140

GGATGACGGG CCTCTAGGCG GTCTTCTGCC ACGAGCAGTT TCTCATTACT GTCTGTGGCT  1200

AAGTCCCCTC CCTCCTTTCC AAAAATATAT TACAGTCACA CCATAAAAAA AAAAAAAAAA  1260

AAAAAAAAAA AAAAAAAAAA AAAAAA

SEQ ID NO: 42 Protein sequence
Protein Accession #: NP_071753
1          11         21         31         41         51
|          |          |          |          |          |
MRRPSVRAAG LVLCTLCYLL VGAAVFDALE SEAESGRQRL LVQKRGALRR KFGFSAEDYR    60

ELERLALQAE PHRAGRQWKF PGSFYFAITV ITTIGYHAA  PGTDSGKVFC MFYALLGIPL   120

TLVTFQSLGE RLNAVVRRLL LAAKCCLGLR WTCVSTENLV VAGLLACAAT LALGAVAFSH   180

FEGWTFFHAY YYCFITLTTI GFGDFVALQS GEALQRKLPY VAFSFLYILL GLTVIGAFLN   240

LVVLRFLVAS ADWPERAARP PSPRPPGAPE SRGLWLPRRP ARSVGSASVF CHVHKLERCA   300

RDNLGFSPPS SPGVVRGGQA PRPGARWKSI

SEQ ID NO: 43 DNA sequence
Nucleic Acid Accession #: NM_000869.1
Coding sequence: 220. .1656
1          11         21         31         41         51
|          |          |          |          |          |
GGAAACATGA TCCAGCTGAA GGACTGATTG CAGGAAAACT TGGCAGCTCC CCAACCTTGG    60

TGGCCCAGGG AGTGTGAGGC TGCAGCCTCA GAAGGTGTGA GCAGTGGCCA CGAGAGGCAG   120

GCTGGCTGGG ACATGAGGTT GGCAGAGGGC AGGCAAGCTG GCCCTTGGTG GGCCTCGCCC   180

TGAGCACTCG GAGGCACTCC TATGCTTGGA AAGCTCGCTA TGCTGCTGTG GGTCCAGCAG   240

GCGCTGCTCG CCTTGCTCCT CCCCACACTC TGGCACAGG  GAGAAGCCAG GAGGAGCCGA   300

AACACCACCA GGCCCGCTCT GCTGAGGCTG TCGGATTACC TTTTGACCAA CTACAGGAAG   360

GGTGTGCGCC CCGTGAGGGA CTGGAGGAAG CCAACCACCG TATCCATTGA CGTCATTGTC   420

TATGCCATCC TCAACGTGGA TGAGAAGAAT CAGGTGCTGA CCACCTACAT CTGGTACCGG   480

CAGTACTGGA CTGATGAGTT TCTCCAGTGG AACCCTGAGG ACTTTGACAA CATCACCAAG   540

TTGTCCATCC CCACGGACAG CATCTGGGTC CCGGACATTC TCATCAATGA GTTCGTGGAT   600

GTGGGGAAGT CTCCAAATAT CCCGTACGTG TATATTCGGC ATCAAGGCGA AGTTCAGAAC   660

TACAAGCCCC TTCAGGTGGT GACTGCCTGT AGCCTCGACA TCTACAACTT CCCCTTCGAT   720

GTCCAGAACT GCTCGCTGAC CTTCACCAGT TGGCTGCACA CCATCCAGGA CATCAACATC   780

TCTTTGTGGC GCTTGCCAGA AAAGGTGAAA TCCGACAGGA GTGTCTTCAT GAACCAGGGA   840

GAGTGGGAGT TGCTGGGGGT GCTGCCCTAC TTTCGGGAGT TCAGCATGGA AAGCAGTAAC   900

TACTATGCAG AAATGAAGTT CTATGTGGTC ATCCGCCGGC GGCCCCTCTT CTATGTGGTC   960
```

TABLE 20-continued

```
AGCCTGCTAC TGCCCAGCAT CTTCCTCATG GTCATGGACA TCGTGGGCTT CTACCTGCCC 1020

CCCAACAGTG GCGAGAGGGT CTCTTTCAAG ATTACACTCC TCCTGGGCTA CTCGGTCTTC 1080

CTGATCATCG TTTCTGACAC GCTGCCGGCC ACTGCCATCG GCACTCCTCT CATTGGTGTC 1140

TACTTTGTGG TGTGCATGGC TCTGCTGGTG ATAAGTTTGG CCGAGACCAT CTTCATTGTG 1200

CGGCTGGTGC ACAAGCAAGA CCTGCAGCAG CCCGTGCCTG CTTGGCTGCG TCACCTGGTT 1260

CTGGAGAGAA TCGCCTGGCT ACTTTGCCTG AGGGAGCAGT CAACTTCCCA GAGGCCCCCA 1320

GCCACCTCCC AAGCCACCAA GACTGATGAC TGCTCAGCCA TGGGAAACCA CTGCAGCCAC 1380

ATGGGAGGAC CCCAGGACTT CGAGAAGAGC CCGAGGGACA GATGTAGCCC TCCCCCACCA 1440

CCTCGGGAGG CCTCGCTGGC GGTGTGTGGG CTGCTGCAGG AGCTGTCCTC CATCCGGCAA 1500

TTCCTGGAAA AGCGGGATGA GATCCGAGAG GTGGCCCGAG ACTGGCTGCG CGTGGGCTCC 1560

GTGCTGGACA AGCTGCTATT CCACATTTAC CTGCTAGCGG TGCTGGCCTA CAGCATCACC 1620

CTGGTTATGC TCTGGTCCAT CTGGCAGTAC GCTTGAGTGG GTACAGCCCA GTGGAGGAGG 1680

GGGTACAGTC CTGGTTAGGT GGGGACAGAG GATTTCTGCT TAGGCCCCTC AGGACCCAGG 1740

GAATGCCAGG GACATTTTCA AGACACAGAC AAAGTCCCGT GCCCTGTTTC AATGCCAAT 1800

TCATCTCAGC AATCACAAGC CAAGGTCTGA ACCCTTCCAC CAAAAACTGG GTGTTCAAGG 1860

CCCTTACACC CTTGTCCCAC CCCCAGCAGC TCACCATGGC TTTAAAACAT GCTCTCTTAG 1920

ATCAGGAGAA ACTCGGGCAC TCCCTAAGTC CACTCTAGTT GTGGACTTTT CCCCATTGAC 1980

CCTCACCTGA ATAAGGGACT TTGGAATTCT GCTTCTCTTT CACAACTTTG CTTTTAGGTT 2040

GAAGGCAAAA CCAACTCTCT ACTACACAGG CCTGATAACT CTGTACGAGG CTTCTCTAAC 2100

CCCTAGTGTC TTTTTTTTCT TCACCTCACT TGTGGCAGCT TCCCTGAACA CTCATCCCCC 2160

ATCAGATGAT GGGAGTGGGA AGAATAAAAT GCAGTGAAAC CC
```

SEQ ID NO: 44 Protein sequence
Protein Accession #: NP_000860.1

```
1          11         21         31         41         51
|          |          |          |          |          |
MLLWVQQALL ALLLPTLLAQ GEARRSRNTT RPALLRLSDY LLTNYRKGVR PVRDWRKPTT  60

VSIDVIVYAI LNVDEKNQVL TTYIWYRQYW TDEFLQWNPE DFDNITKLSI PTDSIWVPDI 120

LINEFVDVGK SPNIPYVYIR HQGEVQNYKP LQVVTACSLD IYNFPFDVQN CSLTFTSWLN 180

TIQDINISLW RLPEKVKSDR SVFMNQGEWE LLGVLPYFRE FSMESSNYYA EMKFYVVIRR 240

RPLFYVVSLL LPSIFLMVMD IVGFYLPPNS GERVSFKITL LLGYSVFLII VSDTLPATAI 300

GTPLIGVYFV VCMALLVISL AETIFIVRLV HKQDLQQPVP AWLRHLVLER IAWLLCLREQ 360

STSQRPPATS QATKTDDCSA MGNHCSHMGG PQDFEKSPRD RCSPPPPPRE ASLAVCGLLQ 420

ELSSIRQFLE KRDEIREVAR DWLRVGSVLD KLLFHIYLLA VLAYSITLVM LWSIWQYA
```

SEQ ID NO: 45 DNA sequence
Nucleic Acid Accession #: NM_015507
Coding sequence: 241..1902

```
1          11         21         31         41         51
|          |          |          |          |          |
CCGCAGAGGA GCCTCGGCCA GGCTAGCCAG GGCGCCCCCA GCCCCTCCCC AGGCCGCGAG  60

CGCCCCTGCC GCGGTGCCTG GCCTCCCCTC CCAGACTGCA GGGACAGCAC CCGGTAACTG 120

CGAGTGGAGC GGAGGACCCG AGCGGCTGAG GAGAGAGGAG GCGGCCGCTT AGCTGCTACG 180

GGGTCCGGCC GGCGCCCTCC CGAGGGGGGC TCAGGAGGAG GAAGGAGGAC CCGTGCGAGA 240

ATGCCTCTGC CCTGGAGCCT TGCGCTCCCG CTGCTCCTCT CCTGGGTGGC AGGTCGTTTC 300

GGGAACGCGG CCAGTGCAAG GCATCACGGG TTGTTAGCAT CGGCACGTCA GCCTGGGGTC 360
```

TABLE 20-continued

```
TGTCACTATG GAACTAAACT GGCCTGCTGC TACGGCTGGA GAAGAAACAG CAAGGGAGTC  420
TGTGAAGCTA CATGCGAACC TGGATGTAAG TTTGGTGAGT GCGTGGGACC AAACAAATGC  480
AGATGCTTTC CAGGATACAC CGGGAAAACC TGCAGTCAAG ATGTGAATGA GTGTGGAATG  540
AAACCCCGGC CATGCCAACA CAGATGTGTC AATACACACG GAAGCTACAA GTGCTTTTGC  600
CTCAGTGGCC ACATGCTCAT GCCAGATGCT ACGTGTGTGA ACTCTAGGAC ATGTGCCATG  660
ATAAACTGTC AGTACAGCTG TGAAGACACA GAAGAAGGGC CACAGTGCCT GTGTCCATCC  720
TCAGGACTCC GCCTGGCCCC AAATGGAAGA GACTGTCTAG ATATTGATGA ATGTGCCTCT  780
GGTAAAGTCA TCTGTCCCTA CAATCGAAGA TGTGTGAACA CATTTGGAAG CTACTACTGC  840
AAATGTCACA TTGGTTTCGA ACTGCAATAT ATCAGTGGAC GATATGACTG TATAGATATA  900
AATGAATGTA CTATGGATAG CCATACGTGC AGCCACCATG CCAATTGCTT CAATACCCAA  960
GGGTCCTTCA AGTGTAAATG CAACCAGGGA TATAAAGGCA ATGGACTTCG GTGTTCTGCT 1020
ATCCCTGAAA ATTCTGTGAA GGAAGTCCTC AGAGCACCTG GTACCATCAA AGACAGAATC 1080
AAGAAGTTGC TTGCTCACAA AACAGCATG AAAAGAAGG CAAAAATTAA AAATGTTACC 1140
CCAGAACCCA CCAGGACTCC TACCCCTAAG GTGAACTTGC AGCCCTTCAA CTATGAAGAG 1200
ATAGTTTCCA GAGGCGGGAA CTCTCATGGA GGTAAAAAAG GAATGAAGA GAAAATGAAA 1260
GAGGGGCTTG AGGATGAGAA AAGAGAAGAG AAAGCCCTGA AGAATGACAT AGAGGAGCGA 1320
AGCCTGCGAG GAGATGTGTT TTTCCCTAAG GTGAATGAAG CAGGTGAATT CGGCCTGATT 1380
CTGGTCCAAA GGAAAGCGCT AACTTCCAAA CTGGAACATA AAGATTTAAA TATCTCGGTT 1440
GACTGCAGCT TCAATCATGG GATCTGTGAC TGGAAACAGG ATAGAGAAGA TGATTTTGAC 1500
TGGAATCCTG CTGATCGAGA TAATGCTATT GGCTTCTATA TGGCAGTTCC GGCCTTGGCA 1560
GGTCACAAGA AAGACATTGG CCGATTGAAA CTTCTCCTAC CTGACCTGCA ACCCCAAAGC 1620
AACTTCTGTT TGCTCTTTGA TTACCGGCTG GCCGGAGACA AAGTCGGGAA ACTTCGAGTG 1680
TTTGTGAAAA ACAGTAACAA TGCCCTGGCA TGGGAGAAGA CCACGAGTGA GGATGAAAAG 1740
TGGAAGACAG GGAAAATTCA GTTGTATCAA GGAACTGATG CTACCAAAAG CATCATTTTT 1800
GAAGCAGAAC GTGGCAAGGG CAAAACCGGC GAAATCGCAG TGGATGGCGT CTTGCTTGTT 1860
TCAGGCTTAT GTCCAGATAG CCTTTTATCT GTGGATGACT GAATGTTACT ATCTTTATAT 1920
TTGACTTTGT ATGTCAGTTC CCTGGTTTTT TTGATATTGC ATCATAGGAC CTCTGGCATT 1980
TTAGAATTAC TAGCTGAAAA ATTGTAATGT ACCAACAGAA ATATTATTGT AAGATGCCTT 2040
TCTTGTATAA GATATGCCAA TATTTGCTTT AAATATCATA TCACTGTATC TTCTCAGTCA 2100
TTTCTGAATC TTTCCACATT ATATTATAAA ATATGGAAAT GTCAGTTTAT CTCCCCTCCT 2160
CAGTATATCT GATTTGTATA AGTAAGTTGA TGAGCTTCTC TCTACAACAT TTCTAGAAAA 2220
TAGAAAAAAA AGCACAGAGA ATGTTTAAC TGTTTGACTC TTATGATACT TCTTGGAAAC 2280
TATGACATCA AAGATAGACT TTTGCCTAAG TGGCTTAGCT GGGTCTTTCA TAGCCAAACT 2340
TGTATATTTA AATTCTTTGT AATAATAATA TCCAAATCAT CAAAAAAAAA AAAAAAA
```

SEQ ID NO: 46 Protein sequence
Protein Accession #: NP_056322

```
1          11         21         31         41         51
|          |          |          |          |          |
MPLPWSLALP LLLSWVAGGF GNAASARHHG LLASARQPGV CHYGTKLACC YGWRRNSKGV   60

CEATCEPGCK FGECVGPNKC RCFPGYTGKT CSQDVNECGM KPRPCQHRCV NTHGSYKCFC  120

LSGHMLMPDA TCVNSRTCAM INCQYSCEDT EEGPQCLCPS SGLRLAPNGR DCLDIDECAS  180

GKVICPYNRR CVNTFGSYYC KCHIGFELQY ISGRYDCIDI NECTMDSHTC SHHANCFNTQ  240
```

TABLE 20-continued

```
GSFKCKCKQG YKGNGLRCSA IPENSVKEVL RAPGTIKDRI KKLLAHKNSM KKKAKIKNVT  300

PEPTRTPTPK VNLQPFNYEE IVSRGGNSHG GKKGNEEKMK EGLEDEKREE KALKNDIEER  360

SLRGDVFFPK VNEAGEFGLI LVQRKALTSK LEHKDLNISV DCSFNHGICD WKQDREDDFD  420

WNPADRDNAI GFYMAVPALA GHKKDIGRLK LLLPDLQPQS NFCLLFDYRL AGDKVGKLRV  480

FVKNSNNALA WEKTTSEDEK WKTGKIQLYQ GTDATKSIIF EAERGKGKTG EIAVDGVLLV  540

SGLCPDSLLS VDD

SEQ ID NO: 47 DNA sequence
Nucleic Acid Accession #: NM_005046
Coding sequence: 16. .777
1          11         21         31         41         51
|          |          |          |          |          |
GGATTTCCGG GCTCCATGGC AAGATCCCTT CTCCTGCCCC TGCAGATCCT ACTGCTATCC   60

TTAGCCTTGG AAACTGCAGG AGAAGAAGCC CAGGGTGACA AGATTATTGA TGGCGCCCCA  120

TGTGCAAGAG GCTCCCACCC ATGGCAGGTG GCCCTGCTCA GTGGCAATCA GCTCCACTGC  180

GGAGGCGTCC TGGTCAATGA GCGCTGGGTG CTCACTGCCG CCCACTGCAA GATGAATGAG  240

TACACCGTGC ACCTGGGCAG TGATACGCTG GGCCACAGGA GAGCTCAGAG GATCAAGGCC  300

TCGAAGTCAT TCCGCCACCC CGGCTACTCC ACACAGACCC ATGTTAATGA CCTCATGCTC  360

GTGAAGCTCA ATAGCCAGGC CAGGCTGTCA TCCATGGTGA AGAAAGTCAG GCTGCCCTCC  420

CGCTGCGAAC CCCCTGGAAC CACCTGTACT GTCTCCGGCT GGGGCACTAC CACGAGCCCA  480

GATGTGACGT TTCCCTCTGA CCTCATGTGC GTGGATGTCA AGCTCATCTC CCCCCAGGAC  540

TGCACGAAGG TTTACAAGGA CTTACTGGAA AATTCCATGC TGTGCGCTGG CATCCCCGAC  600

TCCAAGAAAA ACGCCTGCAA TGGTGACTCA GGGGGACCGT TGGTGTGCAG AGGTACCCTG  660

CAAGGTCTGG TGTCCTGGGG AACTTTCCCT TGCGGCCAAC CCAATGACCC AGGAGTCTAC  720

ACTCAAGTGT GCAAGTTCAC CAAGTGGATA AATGACACCA TGAAAAAGCA TCGCTAACGC  780

CACACTGAGT TAATTAACTG TGTGCTTCCA ACAGAAAATG CACAGGAGTG AGGACGCCGA  840

TGACCTATGA AGTCAAATTT GACTTTACCT TTCCTCAAAG ATATATTTAA ACCTCATGCC  900

CTGTTGATAA ACCAATCAAA TTGGTAAAGA CCTAAAACCA AACAAATAA AGAAACACAA  960

AACCCTCAA

SEQ ID NO: 48 Protein sequence
Protein Accession #: NP_005037
1          11         21         31         41         51
|          |          |          |          |          |
MARSLLLPLQ ILLLSLALET AGEEAQGDKI IDGAPCARGS NPWQVALLSG NQLNCGGVLV   60

NESWVLTAAH CKMNEYTVHL GSDTLGDRRA QRIKASKSFR HPGYSTQTHV NDLMLVKLNS  120

QARLSSMVKK VRLPSRCEPP GTTCTVSGWG TTTSPDVTEP SDLMCVDVKL ISPQDCTKVY  180

KDLLENSMLC AGIPDSKKNA CNGDSGGPLV CRGTLQGLVS WGTFPCGQPN DPGVYTQVCK  240

FTKWINDTMK KHR

SEQ ID NO: 49 DNA sequence
Nucleic Acid Accession #: NM_003466.1
Coding sequence: 11 1363
1          11         21         31         41         51
|          |          |          |          |          |
GAATTCGGCG ATGCCICACA ACTCCATCAG ATCTGGCCAT GGAGGGCTGA ACCAGCTGGG   60

AGGGGCCTTT GTGAATGGCA GACCTCTGCC GGAAGTGGTC CGCCACCGCA TCGTAGACCT  120

GGCCCACCAG GGTGTAAGGC CCTGCGACAT CTCTCGCCAG CTCCGCGTCA GCCATGGTTG  180

CGTCAGCAAG ATCCTTGGCA GGTACTACGA GACTGGCAGC ATCCGGCCTG GAGTGATAGG  240
```

TABLE 20-continued

```
GGGCTCCAAG CCCAAGGTGG CCACCCCCAA GGTGGTGGAG AAGATTGGGG ACTACAAACG   300

CCAGAACCCT ACCATGTTTG CCTGGGAGAT CCGAGACCGG CTCCTGGCTG AGGGCGTCTG   360

TGACAATGAC ACTGTGCCCA GTGTCAGCTC CATTAATAGA ATCATCCGGA CCAAAGTGCA   420

GCAACCATTC AACCTCCCTA TGGACAGCTG CGTGGCCACC AAGTCCCTGA GTCCCGGACA   480

CACGCTGATC CCCAGCTCAG CTGTAACTCC CCCGGAGTCA CCCCAGTCGG ATTCCCTGGG   540

CTCCACCTAC TCCATCAATG GGCTCCTGGG CATCGCTCAG CCTGGCAGCG ACAAGAGGAA   600

AATGGATGAC AGTGATCAGG ATAGCTGCCG ACTAAGCATT GACTCACAGA GCACCACCAG   660

CGGACCCCGA AAGCACCTTC GCACGGATGC CTTCAGCCAG CACCACCTCG AGCCGCTCGA   720

GTGCCCATTT GAGCGGCAGC ACTACCCAGA GGCCTATGCC TCCCCCAGCC ACACCAAAGG   780

CGAGCAGGGC CTCTACCCGC TGCCCTTGCT CAACAGCACC CTGGACGACG GAAGGCCAC    840

CCTGACCCCT TCCAACACGC CACTGGGGCG CAACCTCTCG ACTCACCAGA CCTACCCCGT   900

GGTGGCAGAT CCTCACTCAC CCTTCGCCAT AAAGCAGGAA ACCCCCGAGG TGTCCAGTTC   960

TAGCTCCACC CCTTCCTCTT TATCTAGCTC CGCCTTTTTG GATCTGCAGC AAGTCGGCTC  1020

CGGGGTCCCG CCCTTCAATG CCTTTCCCCA TGCTGCCTCC GTGTACGGGC AGTTCACGGG  1080

CCAGGCCCTC CTCTCAGGGC GAGAGATGGT GGGGCCCACG CTGCCCGGAT ACCCACCCCA  1140

CATCCCCACC AGCGGACAGG GCAGCTATGC CTCCTCTGCC ATCGCAGGCA TGGTGGGAGG  1200

AAGTGAATAC TCTGGCAATG CCTATGGCCA CACCCCCTAC TCCTCCTACA GCGAGGCCTG  1260

GCGCTTCCCC AACTCCAGCT TGCTGAGTTC CCCATATTAT TACAGTTCCA CATCAAGGCC  1320

GAGTGCACCG CCCACCACTG CCACGGCCTT TGACCATCTG TAGTTGAAGC TT
```

SEQ ID NO: 50 Protein sequence
Protein Accession #: NP_003457

```
1          11         21         31         41         51
|          |          |          |          |          |
MPHNSIRSGH GGLNQLGGAF VNGRPLPEVV RQRIVDLAHQ GVRPCDISRQ LRVSHGCVSK   60

ILGRYYETGS IRPGVIGGSK PKVATPKVVE KIGDYKRQNP TMFAWEIRDR LLAEGVCDND  120

TVPSVSSINR IIRTKVQQPF NLPMGSCVAT KSLSPGHTLI PSSAVTPPES PQSDSLGSTY  180

SINGLLGIAQ PGSDKRKMDD SDQDSCRLSI DSQSSSSGPR KHLRTDAFSQ HHLEPLECPF  240

ERQNYPEAYA SPSHTKGEQG LYPLPLLNST LDDGKATLTP SNTPLGRNLS TNQTYPVVAD  300

PHSPFAIKQE TPEVSSSSST PSSLSSSAFL DLQQVGSGVP PFNAFPHAAS VYGQFTGQAL  360

LSGREMVGPT LPGYPPHIPT SGQGSYASSA IAGMVAGSEY SGNAYGHTPY SSYSEAWRFP  420

NSSLLSSPYY YSSTSRPSAP PTTATAFDHL
```

SEQ ID NO: 51 DNA sequence
Nucleic Acid Accession #: NM_013962
Coding sequence: 161. 1357

```
1          11         21         31         41         51
|          |          |          |          |          |
TTCAGAAGGA GGAGAGACAC CGGGCCCAGG GCACCCTCGC GGGCGGGCGG ACCCAAGCAG   60

TGAGGGCCTG CAGCCGGCCG CCAGGGCAG CGGCAGGCGC GGCCCGGACC TACGGGAGGA   120

AGCCCCGAGC CCTCGGCGGG CTGCGAGCGA CTCCCCGGCG ATGCCTCACA ACTCCATCAG   180

ATCTGGCCAT GGAGGGCTGA ACCAGCTGGG AGGGGCCTTT GTGAATGGCA GACCTCTGCC   240

GGAAGTGGTC CGCCAGCGCA TCGTAGACCT GGCCCACCAG GGTGTAAGGC CCTGCGACAT   300

CTCTCGCCAG CTCCGCGTCA GCCATGGCTG CGTCAGCAAG ATCCTTGGCA GGTACTACGA   360

GACTGGCAGC ATCCGGCCTG GAGTGATAGG GGGCTCCAAG CCCAAGGTGG CCACCCCCAA   420

GGTGGTGGAG AAGATTGGGG ACTACAAACG CCAGAACCCT ACCATGTTTG CCTGGGAGAT   480
```

TABLE 20-continued

```
CCGAGACCGG CTCCTGGCTG AGGGCGTCTG TGACAATGAC ACTGTGCCCA GTGTCAGCTC    540

CATTAATAGA ATCATCCGGA CCAAAGTGCA GCAACCATTC AACCTCCCTA TGGACAGCTG    600

CGTGGCCACC AAGTCCCTGA GTCCCGGACA CACGCTGATC CCCAGCTCAG CTGTAACTCC    660

CCCGGAGTCA CCCCAGTCGG ATTCCCTGGG CTCCACCTAC TCCATCAATG GGCTCCTGGG    720

CATCGCTCAG CCTGGCAGCG ACAAGAGGAA AATGGATGAC AGTGATCAGG ATAGCTGCCG    780

ACTAAGCATT GACTCACAGA GCAGCAGCAG CGGACCCCGA AAGCACCTTC GCACGGATGC    840

CTTCAGCCAG CACCACCTCG AGCCGCTCGA GTGCCCATTT GAGCGGCAGC ACTACCCAGA    900

GGCCTATGCC TCCCCCAGCC ACACCAAAGG CGACCAGGGC CTCTACCCGC TGCCCTTGCT    960

CAACAGCACC CTGGACGACG GGAAGGCCAC CCTGACCCCT TCCAACACGC CACTGGGGCG   1020

CAACCTCTCG ACTCACCAGA CCTACCCCGT GGTGGCAGCT CCGCCCTTTT GGATCTGCAG   1080

CAAGTCGGCT CCGGGGTCCC GCCCTTCAAT GCCTTTCCCC ATGCTGCCTC CGTGTACGGG   1140

CAGTTCACGG GCCAGGCCCT CCTCTCAGGG CGAGAGATGG TGGGGCCCAC GCTGCCCGGA   1200

TACCCACCCC ACATGCCCAC CAGCGGACAG GGCAGCTATG CCTCCTCTGC CATCGCAGGC   1260

ATGGTGGCAG GAAGTGAATA CTCTGGCAAT GCCTATGGCC ACACCCCCTA CTCCTCCTAC   1320

AGCGAGGCCT GGGGCTTCCC CAACTCCAGC TTGCTGAGTT CCCCATATTA TTACAGTTCC   1380

ACATCAAGGC CGAGTGCACC GCCCACCACT GCCACGGCCT TGACCATCT GTAGTTGCCA   1440

TGGGGACAGT G
```

SEQ ID NO: 52 Protein sequence
Protein Accession #: NP_039246

```
1          11         21         31         41         51
|          |          |          |          |          |
MPHNSIRSGH GGLNQLGGAF VNGRPLPEVV RQRIVDLAHQ GVRPCDISRQ LRVSHGCVSK    60

ILGRYYETGS IRPGVIGGSK PKVATPKVVE KIGDYKRQNP TMFAWEIRDR LLAEGVCDND   120

TVPSVSSINR IIRTKVQQPF NLPMDSCVAT KSLSPGHTLI PSSAVTPPES PQSDSLGSTY   160

SINGLLGIAQ PGSDKRKMDD SDQDSCRLSI DSQSSSSGPR KHLRTDAPSQ HHLEPLECPF   240

ERQHYPEAYA SPSHTKGEQG LYPLPLLNST LDDGKATLTP SNTPLGRNLS THQTYPVVAA   300

PPFWICSKSA PGSRPSMPFP MLPPCTGSSR ARPSSQGERW WGPRCPDTHP TSPPADRAAM   360

PPLPSQAWWQ EVNTLAMPMA TPPTPPTARP GASPTPAC
```

SEQ ID NO: 53 DNA sequence
Nucleic Acid Accession #: NN_012427
Coding sequence: 43..924

```
1          11         21         31         41         51
|          |          |          |          |          |
CTTGTGGTTC CTCTCTACTT GGGGAAATCA GGTGCAGCGG CCATGGCTAC AGCAAGACCC    60

CCCTGGATGT GGGTGCTCTG TGCTCTGATC ACAGCCTTGC TTCTGGGGGT CACAGAGCAT   120

GTTCTCGCCA ACAATGATGT TTCCTGTGAC CACCCTCTA ACACCGTGCC CTCTGGGAGC   180

AACCAGGACC TGGAGCTGG GCCGGGGAA GACGCCCGGT CGGATGACAG CAGCAGCCGC   240

ATCATCAATG GATCCGACTG CGATATGCAC ACCCAGCCGT GGCAGGCCGC GCTGTTGCTA   300

AGGCCCAACC AGCTCTACTG CGGGGCGGTG TTGGTGCATC ACAGTGGCT GCTCACGGCC   360

GCCCACTGCA GGAAGAAAGT TTTCAGAGTC CGTCTCGGCC ACTACTCCCT GTCACCAGTT   420

TATGAATCTG GCAGCAGAT GTTCCAGGGG GTCAAATCCA TCCCCCACCC TGGCTACTCC   480

CACCCTGGCC ACTCTAACGA CCTCATGCTC ATCAAACTGA ACAGAAGAAT TCGTCCCACT   540

AAAGATGTCA GACCCATCAA CGTCTCCTCT CATTGTCCCT CTGCTGGGAC AAAGTGCTTG   600

GTGTCTGGCT GGGGGACAAC CAAGAGCCCC CAAGTGCACT TCCCTAAGGT CCTCCAGTGC   660
```

TABLE 20-continued

```
TTGAATATCA GCGTGCTAAG TCAGAAAAGG TGCGAGGATG CTTACCCGAG ACAGATAGAT   720

GACACCATGT TCTGCGCCGG TGACAAAGCA GGTAGAGACT CCTGCCAGGG TGATTCTGGG   780

GGGCCTGTGG TCTGCAATGG CTCCCTGCAG GGACTCGTGT CCTGGGGAGA TTACCCTTGT   640

GCCCGGCCCA ACAGACCGGG TGTCTACACG AACCTCTGCA AGTTCACCAA GTGGATCCAG   900

GAAACCATCC AGGCCAACTC CTGAGTCATC CCAGGACTCA GCACACCGGC ATCCCCACCT   960

GCTGCAGGGA CAGCCCTGAC ACTCCTTTCA GACCCTCATT CCTTCCCAGA GATGTTGAGA  1020

ATGTTCATCT CTCCAGCCCC TGACCCCATG TCTCCTGGAC TCAGGGTCTG CTTCCCCCAC  1080

ATTGGGCTGA CCGTGTCTCT CTAGTTGAAC CCTGGGAACA ATTTCCAAAA CTGTCCAGGG  1140

CGGGGGTTGC GTCTCAATCT CCCTGGGGCA CTTTCATCCT CAAGCTCAGG GCCCATCCCT  1200

TCTCTGCAGC TCTGACCCAA ATTTAGTCCC AGAAATAAAC TGAGAAGTGG AAAAAAAAAA

SEQ ID NO: 54 Protein sequence
Protein Accession #: NP_036559
1          11         21         31         41         51
|          |          |          |          |          |
MATARPPWMW VLCALITALL LGVTEHVLAN NDVSCDHPSN TVPSGSNQDL GAGAGEDARS   60

DDSSSRIING SDCDMHTQPW QAALLLRPNQ LYCGAVLVHP QWLLTAAHCR KKVFRVRLGH  120

YSLSPVYESG QQMFQGVKSI PHPGYSHPGH SNDLMLIKLN RRIRPTKDVR PINVSSHCPS  180

AGTKCLVSGW GTTKSPQVHF PKVLQCLNIS VLSQKRCEDA YPRQIDDTMF CAGDKAGRDS  240

CQGDSGGPVV CNGSLQGLVS WGDYPCARPN RPGVYTNLCK FTKWIQETIQ ANS

SEQ ID NO: 55 DNA sequence
Nucleic Acid Accession #: NM_002214
Coding sequence: 681..2990
1          11         21         31         41         51
|          |          |          |          |          |
CCCAGAGCCG CCTCCCCCTG TTGCTGGCAT CCCGAGCTTC CTCCCTTGCC AGCCAGGACG   60

CTGCCGACTT GTCTTTGCCC GCTGCTCCGC AGACGGGGCT GCAAAGCTGC AACTAATGGT  120

GTTGGCCTCC CTGCCCACCT GTGGAAGCAA CTGCGCTGAT TGATGCGCCA CAGACTTTTT  180

TCCCCTCGAC CTCGCCGGCG TACCCTCCCA CAGATCCAGC ATCACCCAGT GAATGTACAT  240

TAGGGTGGTT TCCCCCCCAG CTTCGGGCTT TGTTTGGGTT TGATTGTGTT TGGCTCTTCG  300

CTAAGCTGAT TTATGCAGCA GAAGCCCCAC CGGCTGGAGA GAAACAAAAG CTCTTTTCTT  360

TGTCCCGGAG CAGGCTGCGG AGCCCTTGCA GAGCCCTCTC TCCAGTCGCC GCCGGGCCCT  420

TGGCCGTCGA AGGAGGTGCT TCTCGCGGAG ACCGCGGGAC CCGCCGTGCC GAGCCGGGAG  480

GGCCGTAGGG GCCCTGAGAT GCCGAGCGGT GCCCGGGCCC GCTTACCTGC ACCGCTTGCT  540

CCGAGCCGCG GGGTCCGCCT GCTAGGCCTG CGGAAAACGT CCTAGCGACA CTCGCCCGCG  600

GGCCCCGAGG TCGCCCGGGA GGCCGAGCCC GCGTCCGGAA GGCAGCCAGG CGGCGGGCGC  660

GGGGCGGGCT GTTTTGCATT ATGTGCGGCT CGGCCCTGGC TTTTTTTACC GCTGCATTTG  720

TCTGCCTGCA AAACGACCGG CGAGGTCCCG CCTCGTTCCT CTGGGCAGCC TGGGTGTTTT  780

CACTTGTTCT TGGACTGGGC CAAGGTGAAG ACAATAGATG TGCATCTTCA AATGCAGCAT  840

CCTGTGCCAG GTGCCTTGCG CTGGGTCCAG AATGTGGATG GTGTGTTCAA GAGGATTTCA  900

TTTCAGGTGG ATCAAGAAGT GAACGTTGTG ATATTGTTTC CAATTTAATA AGCAAAGGCT  960

GCTCAGTTGA TTCAATAGAA TACCCATCTG TGCATGTTAT AATACCCACT GAAAATGAAA 1020

TTAATACCCA GGTGACACCA GGAGAAGTGT CTATCCAGCT GCGTCCAGGA GCCGAAGCTA 1080

ATTTTATGCT GAAAGTTCAT CCTCTGAAGA AATATCCTGT GGATCTTTAT TATCTTGTTG 1140

ATGTCTCAGC ATCAATGCAC AATAATATAG AAAAATTAAA TTCCGTTGGA AACGATTTAT 1200
```

TABLE 20-continued

```
CTAGAAAAAT GGCATTTTTC TCCCGTGACT TTCGTCTTGG ATTTGGCTCA TACGTTGATA 1260
AAACAGTTTC ACCATACATT AGCATCCACC CCGAAAGGAT TCATAATCAA TGCAGTGACT 1320
ACAATTTAGA CTGCATGCCT CCCCATGGAT ACATCCATGT GCTGTCTTTG ACAGAGAACA 1380
TCACTGAGTT TGAGAAAGCA GTTCATAGAC AGAAGATCTC TGGAAACATA GATACACCAG 1440
AAGGAGGTTT TGACGCCATG CTTCAGGCAG CTGTCTGTGA AAGTCATATC GGATGGCGAA 1500
AAGAGGCTAA AAGATTGCTG CTGGTGATGA CAGATCAGAC GTCTCATCTC GCTCTTGATA 1560
GCAAATTGGC AGGCATAGTG GTGCCCAATG ACGGAAACTG TCATCTGAAA AACAACGTCT 1620
ACGTCAAATC GACAACCATG GAACACCCCT CACTAGGCCA ACTTTCAGAG AAATTAATAG 1680
ACAACAACAT TAATGTCATC TTTGCAGTTC AAGGAAAACA ATTTCATTGG TATAAGGATC 1740
TTCTACCCCT CTTGCCAGGC ACCATTGCTG GTGAAATAGA ATCAAAGGCT GGAAACCTCA 1800
ATAATTTGGT AGTGGAAGCC TATCAGAAGC TCATTTCAGA ACTGAAAGTT CAGGTGGAAA 1860
ACCAGGTACA AGGCATCTAT TTTAACATTA CCGCCATCTG TCCAGATGGG TCCAGAAAGC 1920
CAGGCATGGA AGGATGCAGA AACGTGACGA GCAATGATGA AGTTCTTTTC AATGTAACAG 1980
TTACAATGAA AAAATGTGAT GTCACAGGAG CAAAAAACTA TGCAATAATC AAACCTATTG 2040
GTTTTAATGA AACCGCTAAA ATTCATATAC ACAGAAACTG CAGCTGTCAG TGTGAGGACA 2100
ACAGAGGACC TAAAGGAAAG TGTGTAGATG AAACTTTTCT AGATTCCAAG TGTTTCCAGT 2160
GTGATGAGAA TAAATGTCAT TTTGATGAAG ATCAGTTTTC TTCTGAGAGT TGCAAGTCAC 2220
ACAAGGATCA GCCTGTTTGC AGTGGTCGAG GAGTTTGTGT TTGTGGGAAA TGTTCATGTC 2280
ACAAAATTAA GCTTGGAAAA GTGTATGGAA AATACTGTGA AAAGGATGAC TTTTCTTGTC 2340
CATATCACCA TGGAAATCTG TGTCCTGGGC ATGGAGAGTG TGAAGCAGGC AGATGCCAAT 2400
GCTTCAGTGG CTGGGAAGGT GATCGATGCC AGTCCCCTTC AGCAGCAGCC CAGCACTGTG 2460
TCAATTCAAA GGGCCAAGTG TGCAGTGGAA GAGGCACGTG TGTGTGTGGA AGGTGTGAGT 2520
GCACCGATCC CAGGAGCATC GGCCGCTTCT GTGAACACTG CCCCACCTGT TATACACCGT 2580
GCAAGGAAAA CTGGAATTGT ATGCAATGCC TTCACCCTCA CAATTTGTCT CAGGCTATAC 2640
TTGATCAGTG CAAAACCTCA TGTGCTCTCA TGGAACAACA GCATTATGTC GACCAAACTT 2700
CAGAATGTTT CTCCAGCCCA AGCTACTTGA GAATATTTTT CATCATTTTC ATAGTTACAT 2760
TCTTGATTGG GTTGCTTAAA GTCCTGATCA TTAGACAGGT GATACTACAA TGGAATAGTA 2820
ATAAAATTAA GTCCTCATCA GATTACAGAG TGTCAGCCTC AAAAAAGGAT AAGTTGATTC 2880
TGCAAAGTGT TTGCACAAGA GCAGTCACCT ACCGACGTGA GAAGCCTGAA GAAATAAAAA 2940
TGGATATCAG CAAATTAAAT GCTCATGAAA CTTTCAGGTG CAACTTCTAA AAAAGATTT 3000
TTAAACACTT AATGGGAAAC TGGAATTGTT AATAATTGCT CCTAAAGATT ATAATTTTAA 3060
AAGTCACAGG AGGAGACAAA TTGCTCACGG TGATGCCACT TGCTGGTTGT ACACTCGAAC 3120
GAAGACTGAC AAGTATCCTC ATCATGATGT GACTCACATA GCTGCTGACT TTTTCAGAGA 3180
AAAATGTGTC TTACTACTGT TTGAGACTAG TGTCGTTGTA GCACTTTACT GTAATATATA 3240
ACTTATTTAG ATCAGCATAG AATGTAGATC CTCTGAAGAG CACTGATTAC ACTTTACAGG 3300
TACCTGTTAT CCCTACGCTT CCCAGAGAGA ACAATGCTGT GAGAGAGTTT AGCATTGTGT 3360
CACTACAAGG GTACAGTAAT CCCTGCACTG GACATGTGAG GAAAAAAATA ATCTGGCAAG 3420
TATATTCTAA GGTTGCCAAA CACTTCAACA GTTGGTGGTT GAATAGACAA GAACAGCTAG 3480
ATGAATAAAT GATTCGTGTT TCACTCTTTC AAGAGGTGAA CAGATACAAC CTTAATCTTA 3540
AAAGATTATT GCTTTTTAAA GTGTGTAGTT TTATGCATGT GTGTTTATGG TTTGCTTATT 3600
```

TABLE 20-continued

```
TTTGCAAGAT GGATACTAAT TCCAGCATTC TCTCCTCTTT GCCTTTATGT TTTGTTTTCT 3660

TTTTTACAGG ATAAGTTTAT GTATGTCACA GATGACTGGA TTAATTAAGT GCTAAGTTAC 3720

TACTGCCATA AAAAACTAAT AATACAATGT CACTTTATCA GAATACTAGT TTTAAAAGCT 3780

GAATGTTAA

SEQ ID NO: 56 Protein sequence
Protein Accession #: NP_002205
1           11          21          31          41          51
|           |           |           |           |           |
MCGSALAFFT AAFVCLQNDR RGPASFLWAA WVFSLVLGLG QGEDNRCASS NAASCARCLA  60

LGPECGWCVQ EDFISGGSRS ERCDIVSNLI SKGCSVDSIE YPSVHVIIPT ENEINTQVTP 120

GEVSIQLRPG AEANFMLKVH PLKKYPVDLY YLVDVSASMH NNIEKLNSVG NDLSRKMAFF 180

SRDFRLGFGS YVDKTVSPYI SIHPERIHNQ CSDYNLDCMP PHGYIHVLSL TENITEFEKA 240

VHRQKISGNI DTPEGGFDAM LQAAVCESHI GWRKEAKRLL LVMTDQTSHL ALDSKLAGIV 300

VPNDGNCHLK NNVYVKSTTM EHPSLGQLSE KLIDNNINVI FAVQGKQFHW YKDLLPLLPG 360

TIAGEIESKA ANLNNLVVEA YQKLISEVKV QVENQVQGIY FNITAICPDG SRKPGMEGCR 420

NVTSNDEVLF NVTVTMKKCD VTGGKNYAII KPIGFNETAK IHIHRNCSCQ CEDNRGPKGK 480

CVDETPLDSK CFQCDENKCH FDEDQFSSES CKSHKDQPVC SGRGVCVCGK CSCHKIKLGK 540

VYGKYCEKDD FSCPYHHGNL CAGHGECEAG RCQCFSGWEG DRCQCPSAAA QHCVNSKGQV 600

CSGRGTCVCG RCECTDPRSI GRFCEHCPTC YTACKENWNC MQCLHPHNLS QAILDQCKTS 660

CALMEQQHYV DQTSECFSSP SYLRIFFIIF IVTFLIGLLK VLIIRQVILQ WNSNKIKSSS 720

DYRVSASKKD KLILQSVCTR AVTYRREKPE EIKMDISKLN AHETFRCNF

SEQ ID NO: 57 DNA sequence
Nucleic Acid Accession #: NM_001719
Coding sequence: 123. 1418
1           11          21          31          41          51
|           |           |           |           |           |
GGGCGCAGCG GGGCCCGTCT GCAGCAAGTG ACCGACGGCC GGGACGGCCG CCTGCCCCCT  60

CTGCCACCTG GGGCGGTGCG GGCCCGGAGC CCGGAGCCCG GGTAGCGCGT AGAGCCGGCG 120

CGATGCACGT GCGCTCACTG CGAGCTGCGG CGCCGCACAG CTTCGTGGCG CTCTGGGCAC 180

CCCTGTTCCT GCTGCGCTCC GCCCTGGCCG ACTTCAGCCT GGACAACGAG GTGCACTCGA 240

GCTTCATCCA CCGGCGCCTC CGCAGCCAGG AGCGGCGGGA GATGCAGCGC GAGATCCTCT 300

CCATTTTGGG CTTGCCCCAC CGCCCGCGCC CGCACCTCCA GGGCAAGCAC AACTCGGCAC 360

CCATGTTCAT GCTGGACCTG TACAACGCCA TGGCGGTGGA GGAGGGCGGC GGGCCCGGCG 420

GCCAGGGCTT CTCCTACCCC TACAAGGCCG TCTTCAGTAC CCAGGGCCCC CCTCTGGCCA 480

GCCTGCAAGA TAGCCATTTC CTCACCGACG CCGACATGGT CATGAGCTTC GTCAACCTCG 540

TGGAACATGA CAAGGAATTC TTCCACCCAC GCTACCACCA TCGAGAGTTC CGGTTTGATC 600

TTTCCAAGAT CCCAGAAGGG GAAGCTGTCA CGGCAGCCGA ATTCCGGATC TACAAGGACT 660

ACATCCGGGA ACGCTTCGAC AATGAGACGT TCCGGATCAG CGTTTATCAG GTGCTCCAGG 720

AGCACTTGGG CAGGGAATCG GATCTCTTCC TGCTCGACAG CCGTACCCTC TGGGCCTCGG 780

AGGAGGGCTG GCTGGTGTTT GACATCACAG CCACCAGCAA CCACTGGGTG GTCAATCCGC 840

GGCACAACCT GGGCCTGCAG CTCTCGGTGG AGACGCTGGA TGGGCAGAGC ATCAACCCCA 900

AGTTGGCGGG CCTGATTGGG CGGCACGGGC CCCAGAACAA GCAGCCCTTC ATGGTGGCTT 960

TCTTCAAGGC CACGGAGGTC CACTTCCGCA GCATCCGGTC CACGGGGAGC AAACAGCGCA 1020

GCCAGAACCG CTCCAAGACG CCCAAGAACC AGGAAGCCCT GCGGATGGCC AACGTGGCAG 1080
```

TABLE 20-continued

```
AGAACAGCAG CAGCGACCAG AGGCAGGCCT GTAAGAAGCA CGAGCTGTAT GTCAGCTTCC 1140

GAGACCTGGG CTGGCAGGAC TGGATCATCG CGCCTGAAGG CTACGCCGCC TACTACTGTG 1200

AGGGGGAGTG TGCCTTCCCT CTGAACTCCT ACATGAACGC CACCAACCAC GCCATCGTGC 1260

AGACGCTGGT CCACTTCATC AACCCGGAAA CGGTGCCCAA GCCCTGCTGT GCGCCCACGC 1320

AGCTCAATGC CATCTCCGTC CTCTACTTCG ATGACAGCTC CAACGTCATC CTGAAGAAAT 1380

ACAGAAACAT GGTGGTCCGG GCCTGTGGCT GCCACTAGCT CCTCCGAGAA TTCAGACCCT 1440

TTGGGGCCAA GTTTTTCTGG ATCCTCCATT GCTCGCCTTG GCCAGGAACC AGCAGACCAA 1500

CTGCCTTTTG TGAGACCTTC CCCTCCCTAT CCCCAACTTT AAAGGTGTGA GAGTATTAGG 1560

AAACATGAGC AGCATATGGC TTTTGATCAG TTTTTCAGTG GCAGCATCCA ATGAACAAGA 1620

TCCTACAAGC TGTGCAGGCA AAACCTAGCA GGAAAAAAAA ACAACGCATA AGAAAAAATG 1680

GCCGGGCCAG GTCATTGGCT GGGAAGTCTC AGCCATGCAC GGACTCGTTT CCAGAGGTAA 1740

TTATGAGCGC CTACCAGCCA GGCCACCCAG CCGTGGGAGG AAGGGGGCGT GGCAAGGGGT 1800

GGGCACATTG GTGTCTGTGC GAAAGGAAAA TTGACCCGGA AGTTCCTGTA ATAAATGTCA 1860

CAATAAAACG AATGAATG

SEQ ID NO: 58 Protein sequence
Protein Accession #: NP_001710
1          11         21         31         41         51
|          |          |          |          |          |
MHVRSLRAAA PHSFVALWAP LFLLESALAD FSLDNEVNSS FIHRRLRSQE RREMQREILS  60

ILGLPHRPRP HLQGKHNSAP MFMLDLYNAM AVEEGGGPGG QGFSYPYKAV FSTQGPPLAS 120

LQDSHFLTDA DMVMSFVNLV EHDKEFFHPR YHHREFRFDL SKIPEGEAVT AAEFRIYKDY 180

IREREDNETF RISVYQVLQE HLGRESDLFL LDSRTLWASE EGWLVFDITA TSNHWVVNPR 240

HNLGLQLSVE TLDGQSINPK LAGLIGRHGP QNKQPFMVAF FKATEVHFRS IRSTGSKQRS 300

QNRSKTPKNQ EALRMANVAE NSSSDQRQAC KKHELYVSFR DLGWQDWIIA PEGYAAYYCE 360

GECAFPLNSY MNATNHAIVQ TLVHFINPET VPKPCCAPTQ LNAISVLYFD DSSNVILKKY 420

RNMVVRACGC H

SEQ ID NO: 59 DNA sequence
Nucleic Acid Accession #: NM_002821
Coding sequence: 150. 3362
1          11         21         31         41         51
|          |          |          |          |          |
AACTCCCGCC TCGGGACGCC TCGGGGTCGG GCTCCGGCTG CGGCTGCTGC TGCGGCGCCC  60

GCGCTCCGGT GCGTCCGCCT CCTGTGCCCG CCGCGGAGCA GTCTGCGCC  CGCCGTGCGC 120

CCTCAGCTCC TTTTCCTGAG CCCGCCGCGA TGGGAGCTGC GCGGGATCC  CCGGCCAGAC 180

CCCGCCGGTT GCCTCTGCTC AGCGTCCTGC TGCTGCCGCT GCTGGGCGGT ACCCAGACAG 240

CCATTGTCTT CATCAAGCAG CCGTCCTCCC AGGATGCACT GCAGGGGCGC CGGGCGCTGC 300

TTCGCTGTGA GGTTGAGGCT CCGGGCCCGG TACATGTGTA CTGGCTGCTC GATGGGGCCC 360

CTGTCCAGGA CACGGAGCGG CGTTTCGCCC AGGGCAGCAG CCTGAGCTTT GCAGCTGTGG 420

ACCGGCTGCA GGACTCTGGC ACCTTCCAGT GTGTGGCTCG GGATGATGTC ACTGGAGAAG 480

AAGCCCGCAG TGCAACGCC  TCCTTCAACA TCAAATGGAT TGAGGCAGGT CCTGTGGTCC 540

TGAAGCATCC AGCCTCGGAA GCTGAGATCC AGCCACAGAC CCAGGTCACA CTTCGTTGCC 600

ACATTGATGG GCACCCTCGG CCCACCTACC AATGGTTCCG AGATGGGACC CCCCTTTCTG 660

ATGGTCAGAG CAACCACACA GTCAGCAGCA AGGAGCGGAA CCTGACGCTC CGGCCAGCTG 720

GTCCTGAGCA TAGTGGGCTG TATTCCTGCT GCGCCCACAG TGCTTTTGGC CAGGCTTGCA 780
```

TABLE 20-continued

```
GCAGCCAGAA CTTCACCTTG AGCATTGCTG ATGAAAGCTT TGCCAGGGTG GTGCTGGCAC    840
CCCAGGACGT GGTAGTAGCG AGGTATGAGG AGGCCATGTT CCATTGCCAG TTCTCAGCCC    900
AGCCACCCCC GAGCCTGCAG TGGCTCTTTG AGGATGAGAC TCCCATCACT AACCGCAGTC    960
GCCCCCCACA CCTCCGCAGA GCCACAGTGT TTGCCAACGG GTCTCTGCTG CTGACCCAGG   1020
TCCGGCCACG CAATGCAGGG ATCTACCGCT GCATTGGCCA GGGGCAGAGG GGCCCACCCA   1080
TCATCCTGGA AGCCACACTT CACCTAGCAG AGATTGAAGA CATGCCGCTA TTTGAGCCAC   1140
GGGTGTTTAC AGCTGGCAGC GAGGACCGTG TGACCTGCCT TCCCCCCAAG GGTCTGCCAG   1200
AGCCCAGCGT GTGGTGGGAG CACGCGGGAG TCCGGCTGCC CACCCATGGC AGGGTCTACC   1260
AGAAGGGCCA CGAGCTGGTG TTGGCCAATA TTGCTGAAAG TGATGCTGGT GTCTACACCT   1320
GCCACGCGGC CAACCTGGCT GGTCAGCGGA CACAGGATGT CAACATCACT GTGGCCACTG   2380
TGCCCTCCTG GCTGAAGAAG CCCCAAGACA GCCAGCTGGA GGAGGGCAAA CCCGGCTACT   1440
TGGATTGCCT GACCCAGGCC ACACCAAAAC CTACAGTTGT CTGGTACAGA AACCAGATGC   1500
TCATCTCAGA GGACTCACGG TTCGAGGTCT TCAAGAATGG GACCTTGCGC ATCAACAGCG   1560
TGGAGGTGTA TGATGGGACA TGGTACCGTT GTATGAGCAG CACCCCAGCC GGCAGCATCG   1620
AGGCGCAAGC CCGTGTCCAA GTGCTGGAAA AGCTCAAGTT CACACCACCA CCCCAGCCAC   1680
AGCAGTGCAT GGAGTTTGAC AAGGAGGCCA CGGTGCCCTG TTCAGCCACA GGCGAGAGA    1740
AGCCCACTAT TAAGTGGGAA CGGGCAGATG GGAGCAGCCT CCCAGAGTGG GTGACAGACA   1800
ACGCTGGGAC CCTGCATTTT GCCCGGGTCA CTCGAGATGA CGCTGGCAAC TACACTTGCA   1860
TTGCCTCCAA CGGGCCGCAG GGCCAGATTC GTGCCCATGT CCAGCTCACT GTGGCAGTTT   1920
TTATCACCTT CAAAGTGGAA CCAGAGCGTA CGACTGTGTA CCAGGGCCAC ACAGCCCTAC   1980
TGCAGTGCGA GGCCCAGGGG GACCCCAAGC CGCTGATTCA GTGGAAAGGC AAGGACCGCA   2040
TCCTGGACCC CACCAAGCTG GGACCGAGGA TGCACATCTT CCAGAATGGC TCCCTGGTGA   2100
TCCATGACGT GGCCCCTGAG GACTCAGGCC GCTACACCTG CATTGCAGGC AACAGCTGCA   2160
ACATCAAGCA CACGGAGGCC CCCCTCTATG TCGTGGACAA GCCTGTGCCG GAGGAGTCGG   2220
AGGGCCCTGG CAGCCCTCCC CCCTACAAGA TGATCCAGAC CATTGGGTTG TCGGTGGGTG   2280
CCGCTGTGGC CTACATCATT GCCGTGCTGG GCCTCATGTT CTACTGCAAG AAGCGCTGCA   2340
AAGCCAAGCG GCTGCAGAAG CAGCCCGAGG GCGAGGAGCC AGAGATGGAA TGCCTCAACG   2400
GAGGGCCTTT GCAGAACGGG CAGCCCTCAG CAGAGATCCA AGAAGAAGTG GCCTTGACCA   2460
GCTTGGGCTC CGGCCCCGCG GCCACCAACA AACGCCACAG CACAAGTGAT AAGATGCACT   2520
TCCCACGGTC TAGCCTGCAG CCCATCACCA CGCTGGGGAA GAGTGAGTTT GGGGAGGTGT   2560
TCCTGGCAAA GGCTCAGGGC TTGGAGGAGG GAGTGGCAGA GACCCTGGTA CTTGTGAAGA   2640
GCCTGCAGAC GAAGGATGAG CAGCAGCAGC TGGACTTCCG GAGGGAGTTG GAGATGTTTG   2700
GGAAGCTGAA CCACGCCAAC GTGGTGCGGC TCCTGGGGCT GTGCCGGGAG CTGAGCCCC    2760
ACTACATGGT GCTGGAATAT GTGGATCTGG GAGACCTCAA GCAGTTCCTG AGGATTTCCA   2820
AGAGCAAGGA TGAAAAATTG AAGTCACAGC CCCTCAGCAC CAAGCAGAAG GTGGCCCTAT   2880
GCACCCAGGT AGCCCTGGGC ATGGAGCACC TGTCCAACAA CCGCTTTGTG CATAAGGACT   2940
TGGCTGCGCG TAACTGCCTG GTCAGTGCCC AGAGACAAGT GAAGGTGTCT GCCCTGGGCC   3000
TCAGCAAGGA TGTGTACAAC AGTGAGTACT ACCACTTCCG CCAGGCCTGG GTGCCGCTGC   3060
GCTGGATGTC CCCCGAGGCC ATCCTGGAGG GTGACTTCTC TACCAAGTCT GATGTCTGGG   3120
CCTTCGGTGT GCTGATGTGG GAAGTGTTTA CACATGGAGA GATGCCCCAT GGTGGGCAGG   3180
```

TABLE 20-continued

```
CAGATGATGA AGTACTGGCA GATTTGCAGG CTGGGAAGGC TAGACTTCCT CAGCCCGAGG    3240

GCTGCCCTTC CAAACTCTAT CGGCTGATGC AGCGCTGCTG GGCCCTCAGC CCCAAGGACC    3300

GGCCCTCCTT CAGTGAGATT GCCAGCGCCC TGGGAGACAG CACCGTGGAC AGCAAGCCGT    3360

GAGGAGGGAG CCCGCTCAGG ATGGCCTGGG CAGGGGAGGA CATCTCTAGA GGGAAGCTCA    3420

CAGCATGATG GGCAAGATCC CTGTCCTCCT GGGCCCTGAG GTGCCCTAGT GCAACAGGCA    3480

TTGCTGAGGT CTGAGCAGGG CCTGGCCTTT CCTCCTCTTC CTCACCCTCA TCCTTTGGGA    3540

GGCTGACTTG GACCCAAACT GGGCGACTAG GGCTTTGAGC TGGGCAGTTT CCCCTGCCAC    3600

CTCTTCCTCT ATCAGGGACA GTGTGGGTGC CACAGGTAAC CCCAATTTCT GGCCTTCAAC    3660

TTCTCCCCTT GACCGGGTCC AACTCTGCCA CTCATCTGCC AACTTTGCCT GGGGAGGGCT    3720

AGGCTTGGGA TGAGCTGGGT TTGTGGGGAG TTCCTTAATA TTCTCAAGTT CTGGGCACAC    3780

AGGGTTAATG AGTCTCTTGC CCACTGGTCC ACTTGGGGGT CTAGACCAGG ATTATAGAGG    3840

ACACAGCAAG TGAGTCCTCC CCACTCTGGG CTTGTGCACA CTGACCCAGA CCCACGTCTT    3900

CCCCACCCTT CTCTCCTTTC CTCATCCTAA GTGCCTGGCA GATGAAGGAG TTTTCAGGAG    3960

CTTTTGACAC TATATAAACC GCCCTTTTTG TATGCACCAC GGGCGGCTTT TATATGTAAT    4020

TGCAGCGTGG GGTGGGTGGG CATGGGAGGT AGGGGTGGGG CCTGGAGATG AGGAGGGTGG    4080

GCCATCCTTA CCCCACACTT TTATTGTTGT CGTTTTTTGT TTGTTTTGTT TTTTTGTTTT    4140

TGTTTTTGTT TTTACACTCG CTGCTCTCAA TAAATAAGCC TTTTTTA
```

SEQ ID NO: 60 Protein sequence
Protein Accession #: NP_002812

```
1           11          21          31          41          51
|           |           |           |           |           |
MGAARGSPAR  PRRLPLLSVL  LLPLLGGTQT  AIVFIKQPSS  QDALQGRRAL  LRGEVEAPGP    60

VHVYWLLDGA  PVQDTERRFA  QGSSLSFAAV  DRLQDSGTFQ  CVARDDVTGE  EARSANASFN   120

IKWIEAGPVV  LKHPASEAEI  QPQTQVTLRC  HIDGHPRPTY  QWFRDGTPLS  DGQSNHTVSS   180

KERNLTLRPA  GPEHSGLYSC  CAHSAFGQAC  SSQNFTLSIA  DESFARVVLA  PQDVVVARYE   240

EAMPHCQFSA  QPPPSLQWLF  EDETPITNRS  RPPHLRRATV  FANGSLLLTQ  VRPRNAGIYR   300

CIGQGQRGPP  IILEATLHLA  EIEDMPLFEP  RVFTAGSEER  VTCLPPKGLP  EPSVWWEHAG   360

VRLPTHGRVY  QKGHELVLAN  IAESDAGVYT  CHAANLAGQR  RQDVNITVAT  VPSWLKKPQD   420

SQLEEGKPGY  LDCLTQATPK  PTVVWYRNQM  LISEDSRFEV  FKNGTLRINS  VEVYDGTWYR   480

CMSSTPAGSI  EAQARVQVLE  KLKFTPPPQP  QQCMEFDKEA  TVPCSATGRE  KPTIEWERAD   540

GSSLPEWVTD  NAGTLHFARV  TRDDAGNYTC  IASNGPQGQI  RAHVQLTVAV  FITFKVEPER   600

TTVYQGHTAL  LQCEAQGDPK  PLIQWKGKDR  ILDPTKLGPR  MHIFQNGSLV  IHDVAPEDSG   660

RYTCIAGNSC  NIKHTEAPLY  VVDKPVPEES  EGPGSPPPYK  MIQTIGLSVG  AAVAYIIAVL   720

GLMFYCKKRC  KAKRLQKQPE  GEEPEMECLN  GGPLQNGQPS  AEIQEEVALT  SLGSGPAATN   780

KRHSTSDKMH  FPRSSLQPIT  TLGKSEFGEV  FLAKAQGLEE  GVAETLVLVK  SLQTKDEQQQ   840

LDFRRELEMP  GKLNHANVVR  LLGLCREAEP  HYMVLEYVDL  GDLKQFLRIS  KSKDEKLKSQ   900

PLSTKQKVAL  CTQVALGMEH  LSNNRFVHKD  LAARNCLVSA  QRQVKVSALG  LSKDVYNSEY   960

YHFRQAWVPL  RWMSPEAILE  GDFSTKSDVW  AFGVLMWEVF  THGEMPHGGQ  ADDEVLADLQ  1020

AGKARLPQPE  GCPSKLYRLM  QRCWALSPKD  RPSFSEIASA  LGDSTVDSKP
```

TABLE 20-continued

```
SEQ ID NO: 61 DNA sequence
Nucleic Acid Accession #: NN_006103
Coding sequence: 29..406
1         11        21        31        41        51
|         |         |         |         |         |
CACCTGCACC CCGCCCGGGC ATAGCACCAT GCCTGCTTGT CGCCTAGGCC CGCTAGCCGC   60

CGCCCTCCTC CTCAGCCTGC TGCTGTTCGG CTTCACCCTA GTCTCAGGCA CAGGAGCAGA  120

GAAGACTGGC GTGTGCCCCG AGCTCCAGGC TGACCAGAAC TGCACGCAAG AGTGCGTCTC  180

GGACAGCGAA TGCGCCGACA ACCTCAAGTG CTGCAGCGCG GGCTGTGCCA CCTTCTGCCT  240

TCTCTGCCCA AATGATAAGG AGGGTTCCTG CCGCCAGGTG AACATTAACT TTCCCCAGCT  300

CGGCCTCTGT CGGGACCAGT GCCAGGTGGA CAGCCAGTGT CCTGGCCAGA TGAAATGCTG  360

CCGCAATGGC TGTGGGAAGG TGTCCTGTGT CACTCCCAAT TTCTGAGGTC CAGCCACCAC  420

CAGGCTGAGC AGTGAGGAGA GAAAGTTTCT GCCTGGCCCT GCATCTGGTT CCAGCCCACC  480

TGCCCTCCCC TTTTTCGGGA CTCTGTATTC CCTCTTGGGC TGACCACAGC TTCTCCCTTT  540

CCCAACCAAT AAAGTAACCA CTTTCAGCAA AAAAAAAAA AAAA

SEQ ID NO 62 Protein sequence
Protein Accession #: NP_006094
1         11        21        31        41        51
|         |         |         |         |         |
MPACRLGPLA AALLLSLLLF GFTLVSGTGA EKTGVCPELQ ADQNCTQECV SDSECADNLK   60

CCSAGCATFC LLCPNDKEGS CPQVNINFPQ LGLCRDQCQV DSQCPGQMKC CRNGCGKVSC  120

VTPNF

SEQ ID NO: 63 DNA sequence
Nucleic Acid Accession #. NN_001203
Coding sequence: 274..1782
1         11        21        31        41        51
|         |         |         |         |         |
CGCGGGGCGC GGAGTCGGCG GGGCCTCGCG GGACGCGGGC AGTGCGGAGA CCGCGGCGCT   60

GAGGACGCGG GAGCCGGGAG CGCACGCGCG GGGTGGAGTT CAGCCTACTC TTTCTTAGAT  120

GTGAAAGGAA AGGAAGATCA TTTCATGCCT TGTTGATAAA GGTTCAGACT TCTGCTGATT  180

CATAACCATT TGGCTCTGAG CTATGACAAG AGAGGAAACA AAAAGTTAAA CTTACAAGCC  240

TGCCATAAGT GAGAAGCAAA CTTCCTTGAT AACATGCTTT TGCGAAGTGC AGGAAAATTA  300

AATGTGGGCA CCAAGAAAGA GGATGGTGAG AGTACAGCCC CCACCCCCCG TCCAAAGGTC  360

TTGCGTTGTA AATGCCACCA CCATTGTCCA GAAGACTCAG TCAACAATAT TTGCAGCACA  420

GACGGATATT GTTTCACGAT GATAGAAGAG GATGACTCTG GGTTGCCTGT GGTCACTTCT  480

GGTTGCGTAG GACTAGAAGG CTCAGATTTT CAGTGTCGGG ACACTCCCAT TCCTCATCAA  540

AGAAGATCAA TTGAATGCTG CACAGAAAGG AACGAATGTA ATAAAGACCT ACACCCTACA  600

CTGCCTCCAT TGAAAACAG AGATTTTGTT GATGGACCTA TACACCACAG GCTTTACTT  660

ATATCTGTGA CTGTCTGTAG TTTGCTCTTG GTCCTTATCA TATTATTTTG TTACTTCCGG  720

TATAAAAGAC AAGAAACCAG ACCTCGATAC AGCATTGGGT TAGAACAGGA TGAAACTTAC  780

ATTCCTCCTG GAGAATCCCT GAGAGACTTA ATTGAGCAGT CTCAGAGCTC AGGAAGTGGA  840

TCAGGCCTCC CTCTGCTGGT CCAAAGGACT ATAGCTAAGC AGATTCAGAT GGTGAAACAG  900

ATTGGAAAAG GTCGCTATGG GGAAGTTTGG ATGGGAAAGT GGCGTGGCGA AAAGGTAGCT  960

GTGAAAGTGT TCTTCACCAC AGAGGAAGCC AGCTGGTTCA GAGAGACAGA AATATATCAG 1020

ACAGTGTTGA TGAGGCATGA AAACATTTTG GGTTTCATTG CTGCAGATAT CAAAGGGACA 1080

GGGTCCTGGA CCCAGTTGTA CCTAATCACA GACTATCATG AAAATGGTTC CCTTTATGAT 1140

TATCTGAAGT CCACCACCCT AGACGCTAAA TCAATGCTGA AGTTAGCCTA CTCTTCTGTC 1200
```

TABLE 20-continued

```
AGTGGCTTAT GTCATTTACA CACAGAAATC TTTAGTACTC AAGGCAAACC AGCAATTGCC   1260
CATCGAGATC TGAAAAGTAA AAACATTCTG GTGAAGAAAA ATGGAACTTG CTGTATTGCT   1320
GACCTGGGCC TGGCTGTTAA ATTTATTAGT GATACAAATG AAGTTGACAT ACCACCTAAC   1380
ACTCGAGTTG GCACCAAACG CTATATGCCT CCAGAAGTGT TGGAGGAGAG CTTGAACAGA   1440
AATCACTTCC AGTCTTACAT CATGGCTGAC ATGTATAGTT TTGGCCTCAT CCTTTGGGAG   1600
GTTGCTAGGA GATGTGTATC AGGAGGTATA GTGGAAGAAT ACCAGCTTCC TTATCATGAC   1560
CTAGTGCCCA GTGACCCCTC TTATGAGGAC ATGAGGGAGA TTGTGTGCAT CAAGAAGTTA   1620
CGCCCCTCAT TCCCAAACCG GTGGAGCAGT GATGAGTGTC TAAGGCAGAT GGGAAAACTC   1680
ATGACAGAAT GCTGGGCTCA CAATCCTGCA TCAAGGCTGA CAGCCCTGCG GGTTAAGAAA   1740
ACACTTGCCA AAATGTCAGA GTGCCAGGAC ATTAAACTCT GATAGGAGAG GAAAAGTAAG   1800
CATCTCTGCA GAAAGCCAAC AGGTACTCTT CTGTTTGTGG GCAGAGCAAA AGACATCAAA   1860
TAAGCATCCA CAGTACAAGC CTTGAACATC GTCCTGCTTC CCAGTGGGTT CAGACCTCAC   1920
CTTTCAGGGA GCGACCTGGG CAAAGACAGA GAAGCTCCCA GAAGGAGAGA TTGATCCGTG   1980
TCTGTTTGTA GGCGGAGAAA CCGTTGGGTA ACTTGTTCAA GATATGATGC AT

SEQ ID NO: 64 Protein sequence
Protein Accession #: NP_001194
1          11         21         31         41         51
|          |          |          |          |          |
MLLRSAGKLN VGTKKEDGES TAPTPRPKVL RCKCHHHCPE DSVNNICSTD GYCFTMIEED    60
DSGLPVVTSG CLGLEGSDFQ CRDTPIPHQR RSIECCTERN ECNKDLNPTL PPLKNRDFVD  120
GPIHHRALLI SVTVCSLLLV LIILFCYFRY KRQETRPRYS IGLEQDETYI PPGESLRDLI  180
EQSQSSGSGS GLPLLVQRTI AKQIQMVKQI GKGRYGEVWM GKWRGEKVAV KVFFTTEEAS  240
WFRETEIYQT VLMRHENILG FIAADIKGTG SWTQLYLITD YHENGSLYDY LKSTTLDAKS  300
MLKLAYSSVS GLCHLHTEIF STQGKPAIAH RDLKSKNILV KKNGTCCIAD LGLAVKFISD  360
TNEVDIPPNT RVGTKRYMPP EVLDESLNRN HFQSYIMADM YSFGLILWEV ARRCVSGGIV  420
EEYQLPYHDL VPSDPSYEDM REIVCIKKLR PSFPNRWSSD ECLRQMGKLM TECWAHNPAS  480
RLTALRVKKT LAENSESQDI KL SEQ ID NO 65 DNA sequence
Nucleic Acid Accession #: NN_006475.1
Coding sequence 28..2538
1          11         21         31         41         51
|          |          |          |          |          |
AACAGAACTG CAACGGAGAG ACTCAAGATG ATTCCCTTTT TACCCATGTT TTCTCTACTA    60
TTGCTGCTTA TTTGTTAACCC TATAAACGCC AACAATCATT ATGACAAGAT CTTGGCTCAT  120
AGTCGTATCA GGGGTCGGGA CCAAGGCCCA AATGTCTGTG CCCTTCAACA GATTTTGGGC  180
ACCAAAAAGA AATACTTCAG CACTTGTAAG AACTGGTATA AAAAGTCCAT CTGTGGACAG  240
AAAACGACTG TTTTATATGA ATGTTGCCCT GGTTATATGA AATGGAAGG AATGAAAGGC  300
TGCCCAGCAG TTTTGCCCAT TGACCATGTT TATGGCACTC TGGGCATCGT GGGAGCCACC  360
ACAACGCAGC GCTATTCTGA CGCCTCAAAA CTGAGGGAGG AGATCGAGGG AAAGGGATCC  420
TTCACTTACT TTGCACCGAG TAATGAGGCT TGGGACAACT TGGATTCTGA TATCCGTAGA  480
GGTTTGGAGA GCAACGTGAA TGTTGAATTA CTGAATGCTT ACATAGTCA CATGATTAAT  540
AAGAGAATGT TGACCAAGGA CTTAAAAAAT GGCATGATTA TTCCTTCAAT GTATAACAAT  600
TTGGGGCTTT TCATTAACCA TTATCCTAAT GGGGTTGTCA CTGTTAATTG TGCTCGAATC  660
ATCCATGGGA ACCAGATTGC AACAAATGGT GTTGTCCATG TCATTGACCG TGTGCTTACA  720
```

TABLE 20-continued

```
CAAATTGGTA CCTCAATTCA AGACTTCATT GAAGCAGAAG ATGACCTTTC ATCTTTTAGA    780
GCAGCTGCCA TCACATCGGA CATATTGGAG GCCCTTGGAA GAGACGGTCA CTTCACACTC    840
TTTGCTCCCA CCAATGAGGC TTTTGAGAAA CTTCCACGAG GTGTCCTAGA AAGGTTCATG    900
GGAGACAAAG TGGCTTCCGA AGCTCTTATG AAGTACCACA TCTTAAATAC TCTCCAGTGT    960
TCTGAGTCTA TTATGGGAGG AGCAGTCTTT GAGACGCTGG AAGGAAATAC AATTGAGATA   1020
GGATGTGACG GTGACAGTAT AACAGTAAAT GGAATCAAAA TGGTGAACAA AAAGGATATT   1080
GTGACAAATA ATGGTGTGAT CCATTTGATT GATCAGGTCC TAATTCCTGA TTCTGCCAAA   1140
CAAGTTATTG AGCTGGCTGG AAAACAGCAA ACCACCTTCA CGGATCTTGT GGCCCAATTA   1200
GGCTTGGCAT CTGCTCTGAG GCCAGATGGA GAATACACTT TGCTGGCACC TGTGAATAAT   1260
GCATTTTCTG ATGATACTCT CAGCATGGTT CAGCGCCTCC TTAAATTAAT TCTGCAGAAT   1320
CACATATTGA AAGTAAAAGT TGGCCTTAAT GAGCTTTACA ACGGGCAAAT ACTGGAAACC   1380
ATCGGAGGCA AACAGCTCAG AGTCTTCGTA TATCCTACAC CTGTCTGCAT TGAAAATTCA   1440
TGCATGGAGA AAGGGAGTAA GCAAGGGAGA AACGGTGCGA TTCACATATT CCGCGAGATC   1500
ATCAAGCCAG CAGAGAAATC CCTCCATGAA AAGTTAAAAC AAGATAAGCG CTTTAGCACC   1560
TTCCTCAGCC TACTTGAAGC TGCAGACTTG AAAGAGCTCC TGACACAACC TGGAGACTGG   1620
ACATTATTTG TGCCAACCAA TGATGCTTTT AAGGGAATGA CTAGTGAAGA AAAAGAAATT   1680
CTGATACGGG ACAAAAATGC TCTTCAAAAC ATCATTCTTT ATCACCTGAC ACCAGGAGTT   1740
TTCATTGGAA AAGGATTTGA ACCTGGTGTT ACTAACATTT TAAAGACCAC ACAAGGAAGC   1800
AAAATCTTTC TGAAAGAAGT AAATGATACA CTTCTGGTGA ATGAATTGAA ATCAAAAGAA   1860
TCTGACATCA TGCAACAAA TGGTGTAATT CATGTTGTAG ATAAACTCCT CTATCCAGCA   1920
GACACACCTG TTGGAAATGA TCAACTGCTG GAAATACTTA ATAAATTAAT CAAATACATC   1980
CAAATTAAGT TTGTTCGTGG TAGCACCTTC AAAGAAATCC CCGTGACTGT CTATACAACT   2040
AAAATTATAA CCAAAGTTGT GGAACCAAAA ATTAAAGTGA TTGAAGGCAG TCTTCAGCCT   2100
ATTATCAAAA CTGAAGGACC CACACTAACA AAAGTCAAAA TTGAAGGTGA ACCTGAATTC   2160
AGACTGATTA AGAAGGTCA AACAATAACT GAAGTGATCC ATGGAGAGCC AATTATTAAA    2220
AAATACACCA AAATCATTGA TGGAGTGCCT GTGAAATAA CTGAAAAAGA GACACGAGAA    2280
GAACGAATCA TTACAGGTCC TGAAATAAAA TACACTAGGA TTTCTACTGG AGGTGGAGAA   2340
ACAGAAGAAA CTCTGAAGAA ATTGTTACAA GAAGAGGTCA CCAAGGTCAC CAAATTCATT   2400
GAAGGTGGTG ATGGTCATTT ATTTGAAGAT GAAGAAATTA AAAGACTGCT TCAGGGAGAC   2460
ACACCCGTGA GGAAGTTGCA AGCCAACAAA AAAGTTCAAG GTTCTAGAAG ACGATTAAGG   2520
GAAGGTCGTT CTCAGTGAAA ATCCAAAAAC CAGAAAAAAA TGTTTATACA ACCCTAAGTC   2580
AATAACCTGA CCTTAGAAAA TTGTGAGAGC CAAGTTGACT TCAGGAACTG AAACATCAGC   2640
ACAAAGAAGC AATCATCAAA TAATTCTGAA CACAAATTTA ATATTTTTTT TTCTGAATGA   2700
GAAACATGAG GGAAATTGTG GAGTTAGCCT CCTGTGGTAA AGGAATTGAA GAAAATATAA   2760
CACCTTACAC CCTTTTTCAT CTTGACATTA AAAGTTCTGG CTAACTTTGG AATCCATTAG   2820
AGAAAAATCC TTGTCACCAG ATTCATTACA ATTCAAATCG AAGAGTTGTG AACTGTTATC   2880
CCATTGAAAA GACCGAGCCT TGTATGTATG TTATGGATAC ATAAAATGCA CGCAAGCCAT   2940
TATCTCTCCA TGGGAAGCTA AGTTATAAAA ATAGGTGCTT GGTGTACAAA ACTTTTTATA   3000
TCAAAAGGCT TTGCACATTT CTATATGAGT GGGTTTACTG GTAAATTATG TTATTTTTTA   3060
CAACTAATTT TGTACTCTCA GAATGTTTGT CATATGCTTC TTGCAATGCA TATTTTTTAA   3120
```

TABLE 20-continued

```
TCTCAAACGT TTCAATAAAA CCATTTTTCA GATATAAAGA GAATTACTTC AAATTGAGTA  3180

ATTCAGAAAA ACTCAAGATT TAAGTTAAAA AGTGGTTTGG ACTTGGGAA
```

SEQ ID NO 66 protein sequence
Protein Accession #: NP_006466.1

```
1          11         21         31         41         51
|          |          |          |          |          |
MIPFLPMFSL LLLLIVNPIN ANNHYDKILA HSRIRGRDQG PNVCALQQIL GTKKKYFSTC   60

KNWYKKSICG QKTTVLYECC PGYMRMEGMK GCPAVLPIDH VYGTLGIVGA TTTQRYSDAS  120

KLREEIEGKG SFTYFAPSNE AWDNLDSDIR RGLESNVNVE LLNALHSHMI NKRMLTKDLK  180

NGMIIPSMYN NLGLFINHYP NGVVTVNCAR IIHGNQIATN GVVHVIDRVL TQIGTSIQDF  240

IEAEDDLSSF RAAAITSDIL EALGRDGHFT LFAPTNEAFE KLPRGVLERF MGDEVASEAL  300

MKYHILNTLQ CSESIMGGAV FETLEGNTIE IGCDGDSITV NGIKMVNKKD IVTNNGVIHL  360

IDQVLIPDSA KQVIELAGKQ QTTFTDLVAQ LGLASALRPD GEYTLLAPVN NAFSDDTLSM  420

VGRLLELILQ NHILKVKVGL NELYNGQILE TIGGKQLRVF VYRTAVCIEN SCMEKGSKQG  480

RNGAIHIFRE IIKPAEKSLH EKLKQDKRFS TFLSLLEAAD LKELLTQPGD WTLFVPTNDA  540

FKGMTSEEKE ILIRDKNALQ NIILYHLTPG VFIGKGPEPG VTNILKTTQG SKIFLKEVND  600

TLLVNELKSK ESDIMTTNGV IHVVDKLLYP ADTPVGNDQL LEILNKLIKY IQIKFVRGST  660

FKEIPVTVYT TKIITKVVEP KIKVIEGSLQ PIIKTEGPTL TKVKIEGEPE FRLIKEGETI  720

TEVIHGEPII KKYTKIIDGV PVEITEKETR EERIITGPEI KYTRISTGGG ETEETLKKLL  780

QEEVTKVTKF IEGGDGHLFE DEEIKRLLQG DTPVRKLQAN KKVQGSRRRL REGRSQ
```

SEQ ID NO: 67 DNA sequence
Nucleic Acid Accession #: EOS sequence
Coding sequence: 1-927

```
1          11         21         31         41         51
|          |          |          |          |          |
ATGCCTGGGG GGTGCTCCCG GGGCCCCGCC GCCGGGGACG GCGTCTGCG GCTGGCGCGA   60

CTAGCGCTGG TACTCCTGGG CTGGGTCTCC TCGTCTTCTC CCACCTCCTC GGCATCCTCC  120

TTCTCCTCCT CGGCGCCGTT CCTGGCTTCC GCCGTGTCCG CCCAGCCCCC GCTGCCGGAC  180

CAGTGCCCCG CGCTGTGCGA GTGCTCCGAG GCAGCGCGCA CAGTCAAGTG CGTTAACCGC  240

AATCTGACCG AGGTGCCCAC GGACCTGCCC GCCTACGTGC GCAACCTCTT CCTTACCGGC  300

AACCAGCTGG CCAGCAACCA CTTCCTTTAC CTGCCGCGGG ATGTGCTGGC CCAACTGCCC  360

AGCCTCAGGC ACCTGGACTT AAGTAATAAT TCGCTGGTGA GCCTGACCTA CGTGTCCTTC  420

CGCAACCTGA CACATCTAGA AAGCCTCCAC CTGGAGGACA ATGCCCTCAA GGTCCTTCAC  480

AATGGCACCC TGGCTGAGTT GCAAGGTCTA CCCCACATTA GGGTTTTCCT GGACAACAAT  540

CCCTGGGTCT GCGACTGCCA CATGGCAGAC ATGGTGACCT GGCTCAAGGA ACAGAGGTA   600

GTGCAGGGCA AGACCGGCT CACCTGTGCA TATCCGAAA AAATGAGGAA TCGGGTCCTC   660

TTGGAACTCA ACAGTGCTGA CCTGGACTGT GACCCGATTC TTCCCCCATC CCTGCAAACC  720

TCTTATGTCT TCCTGGGTAT TGTTTTAGCC CTGATAGGCG CTATTTTCCT CCTGGTTTTG  780

TATTTGAACC GCAAGGGGAT AAAAAAGTGG ATGCATAACA TCAGAGATGC CTGCAGGGAT  840

CACATGGAAG GGTATCATTA CAGATATGAA ATCAATGCGG ACCCCAGATT AACAAACCTC  900

AGTTCTAACT CGGATGTCCT CGAGTGA
```

TABLE 20-continued

```
SEQ ID NO: 68 Protein sequence
Protein Accession #: EOS sequence
1          11         21         31         41         51
|          |          |          |          |          |
MPGGCSRGPA AGDGRLRLAR LALVLLGWVS SSSPTSSASS FSSSAPFLAS AVSAQPPLPD  60

QCPALCECSE AARTVKCVNR NLTEVPTDLP AYVRNLFLTG NQLASNHFLY LPRDVLAQLP 120

SLRHLDLSNN SLVSLTYVSF RNLTHLESLH LEDNALKVLN NGTLAELQGL PHIRVFLDNN 180

PWVCDCHMAD MVTWLKETEV VQGKDRLTCA YPEKMRNRVL LELNSADLDC DPILPPSLQT 240

SYVFLGIVLA LIGAIFLLVL YLNRKGIKKW MHNIRDACRD HMEGYHRYE INADPRLTNL 300

SSNSDVLE

SEQ ID NO: 69 DNA sequence
Nucleic Acid Accession #: NM_000095.1
Coding sequence 26..2299
1          11         21         31         41         51
|          |          |          |          |          |
CAGCACCCAG CTCCCCGCCA CCGCCATGGT CCCCGACACC GCCTGCGTTC TTCTGCTCAC   60

CCTGGCTGCC CTCGGCGCGT CCGGACAGGG CCAGAGCCCG TTGGGCTCAG ACCTGGGCCC  120

GCAGATGCTT CGGGAACTGC AGGAAACCAA CGCGGCGCTG CAGGACGTGC GGGACTGGCT  180

GCGGCAGCAG GTCAGGGAGA TCACGTTCCT GAAAAACACG GTGATGGAGT GTGACGCGTG  240

CGGGATGCAG CAGTCAGTAC GCACCGGCCT ACCCAGCGTG CGGCCCCTGC TCCACTGCGC  300

GCCCGGCTTC TGCTTCCCCG CGTGGCCTG CATCCAGACG GAGAGCGGCG GCCGCTGCGG  360

CCCCTGCCCC GCGGGCTTCA CGGGCAACGG CTCGCACTGC ACCGACGTCA ACGAGTGCAA  420

CGCCCACCCC TGCTTCCCCC GAGTCCGCTG TATCAACACC AGCCCGGGGT TCCGCTGCGA  480

GGCTTGCCCG CCGGGGTACA GCGGCCCCAC CCACCAGGGC GTGGGGCTGG CTTTCGCCAA  540

GGCCAACAAG CAGGTTTGCA CGGACATCAA CGAGTGTGAG ACCGGGCAAC ATAACTGCGT  600

CCCCAACTCC GTGTGCATCA ACACCCGGGG CTCCTTCCAG TGCGGCCCGT GCCAGCCCGG  650

CTTCGTGGGC GACCAGGCGT CCGGCTGCCA GCGCGGCGCA CAGCGCTTCT GCCCCGACGG  720

CTCGCCCAGC GAGTGCCACG AGCATGCAGA CTGCGTCCTA GAGCGCGATG GCTCGCGGTC  780

GTGCGTGTGT CGCGTTGGCT GGGCCGGCAA CGGGATCCTC TGTGGTCGCG ACACTGACCT  840

AGACGGCTTC CCGGACGAGA AGCTGCGCTG CCCGGAGCCG CAGTGCCGTA AGGACAACTG  900

CGTGACTGTG CCCAACTCAG GCAGGAGGA TGTGGACCGC GATGGCATCG AGACGCCTG  960

CGATCCGGAT GCCGACGGGG ACGGGGTCCC CAATGAAAAG ACAACTGCC CGCTGGTGCG 1020

GAACCCAGAC CAGCGCAACA CGGACGAGGA CAAGTGGGGC GATGCGTGCG ACAACTGCCG 1080

GTCCCAGAAG AACGACGACC AAAAGGACAC AGACCAGGAC GGCCGGGGCG ATGCGTGCGA 1140

CGACGACATC GACGGCGACC GGATCCGCAA CCAGGCCGAC AACTGCCCTA GGGTACCCAA 1200

CTCAGACCAG AAGGACAGTG ATGGCGATGG TATAGGGGAT GCCTGTGACA ACTGTCCCCA 1260

GAAGAGCAAC CCGGATCAGG CGGATGTGGA CCACGACTTT GTGGGAGATG CTTGTGACAG 1320

CGATCAAGAC CAGGATGGAG ACGGACATCA GGACTCTCGG GACAACTGTC CCACGGTGCC 1380

TAACAGTGCC CAGGAGGACT CAGACCACGA TGGCCAGGGT GATGCCTGCG ACGACGACGA 1440

CGACAATGAC GGAGTCCCTG ACAGTCGGGA CAACTGCCGC CTGGTGCCTA ACCCCGGCCA 1500

GGAGGACGCG GACAGGGACG GCGTGGGCGA CGTGTGCCAG GACGACTTTG ATGCAGACAA 1580

GGTGGTAGAC AAGATCGACG TGTGTCCGGA GAACGCTGAA GTCACGCTCA CCGACTTCAG 1620

GGCCTTCCAG ACAGTCGTGC TGGACCCGGA GGGTGACGCG CAGATTGACC CCAACTGGGT 1680

GGTGCTCAAC CAGGGAAGGG AGATCGTGCA GACAATGAAC AGCGACCCAG GCCTGGCTGT 1740
```

TABLE 20-continued

```
GGGTTACACT GCCTTCAATG GCGTGGACTT CGAGGGCACG TTCCATGTGA ACACGGTCAC   1800
GGATGACGAC TATGCGGGCT TCATCTTTGG CTACCAGGAC AGCTCCAGCT TCTACGTGGT   1860
CATGTGGAAG CAGATGGAGC AAACGTATTG GCAGGCGAAC CCCTTCCGTG CTGTGGCCGA   1920
GCCTGGCATC CAACTCAAGG CTGTGAAGTC TTCCACAGGC CCCGGGGAAC AGCTGCGGAA   1980
CGCTCTGTGG CATACAGGAG ACACAGAGTC CCAGGTGCGG CTGCTGTGGA AGGACCCGCG   2040
AAACGTGGGT TGGAAGGACA AGAAGTCCTA TCGTTGGTTC CTGCAGCACC GGCCCCAAGT   2100
GGGCTACATC AGGGTGCGAT TCTATGAGGG CCCTGAGCTG GTGGCCGACA GCAACGTGGT   2160
CTTGGACACA ACCATGCGGG GTGGCCGCCT CGGGGTCTTC TGCTTCTCCC AGGAGAACAT   2220
CATCTGGGCC AACCTGCGTT ACCGCTGCAA TGACACCATC CCAGAGGACT ATGAGACCCA   2280
TCAGCTGCGG CAAGCCTAGG GACCAGGGTG AGGACCCGCC GGATGACAGC CACCCTCACC   2340
GCGGCTGGAT GGGGGCTCTG CACCCAGCCC AAGGGGTGGC CGTCCTGAGG GGGAAGTGAG   2400
AAGGGCTCAG AGAGGACAAA ATAAAGTGTG TGTGCAGGG
```

SEQ ID NO: 70 Protein sequence
Protein Accession # NP_000086.1
```
1          11         21         31         41         51
|          |          |          |          |          |
MVPDTACVLL LTLAALGASG QGQSPLGSDL GPQMLRELQE TNAALQDVRD WLRQQVREIT    60
FLKNTVMECD ACGMQQSVRT GLPSVRPLLH CAPGFCFPGV ACIQTESGGR CGPCPAGFTG   120
NGSHCTDVNE CNAHPCFPRV RCINTSPGFR CEACPPGYSG PTHQGVGLAF AKANKQVCTD   180
INECETGQHN CVPNSVCINT RGSFQCGPCQ PGFVGDQASG CQRGAQRFCP DGSPSECHEH   240
ADCVLERDGS RSCVCRVGWA GNGILCGRDT DLDGFPDEKL RCPEPQCRKD NCVTVPNSGQ   300
EDVDRDGIGD ACDPDADGDG VPNEKDNCPL VRNPDQRNTD EDKWGDACDN CRSQKNDDQK   360
DTDQDGRGDA CDDDIDGDRI RNQADNCPRV PNSDQKDSDG DGIGDACDNC PQKSNPDQAD   420
VDHDFVGDAC DSDQDQDGDG HQDSRDNCPT VPNSAQEDSD HDGQGDACDD DDDNDGVPDS   480
RDNCRLVPNP GQEDADRDGV GDVCQDDFDA DKVVDKIDVC PENAEVTLTD FRARQTVVLD   540
PEGDAQIDPN WVVLNQGREI VQTMNSDPGL AVGYTAFNGV DFEGTFHVNT VTDDDYAGFI   600
FGYQDSSSFY VVMWKQMEQT YWQANPFRAV AEPGIQLKAV KSSTGPGEQL RNALWHTGDT   660
ESQVRLLWKD PRNVGWRDKK SYRWFLQHRP QVGYIRVRFY EGPELVADSN VVLDTTMRGG   720
RLGVFCFSQE NIIWANLRYR CNDTIPEDYE THQLRQA
```

SEQ ID NO: 71 DNA sequence
Nucleic Acid Accession #: NN_024626
Coding sequence: 71. 919
```
1          11         21         31         41         51
|          |          |          |          |          |
GAGTCACCAA GGAAGGCAGC GGCAGCTCCA CTCAGCCAGT ACCCAGATAC GCTGGGAACC    60
TTCCCCAGCC ATGGCTTCCC TGGGGCAGAT CCTCTTCTCG AGCATAATTA GCATCATCAT   120
TATTCTGGCT GGAGCAATTG CACTCATCAT TGGCTTTGGT ATTTCAGGGA GACACTCCAT   160
CACAGTCACT ACTGTCGCCT CAGCTGGGAA CATGGGCAG ATGGAATCC TGAGCTGCAC    240
TTTTGAACCT GACATCAAAC TTTCTGATAT CGTGATACAA TGGCTGAAGG AAGGTGTTTT   300
AGGCTTGGTC CATGAGTTCA AGAAGGCAA AGATGAGCTG TCGGAGCAGG ATGAAATGTT    360
CAGAGGCCGG ACAGCAGTGT TGCTGATCA AGTGATAGTT GGCAATGCCT CTTTGCGGCT    420
GAAAAACGTG CAACTCACAG ATGCTGGCAC CTACAAATGT TATATCATCA CTTCTAAAGG   480
CAAGGGGAAT GCTAACCTTG AGTATAAAAC TGGAGCCTTC AGCATGCCGG AAGTGAATGT   540
GGACTATAAT GCCAGCTCAG AGACCTTGCG GTGTGAGGCT CCCCGATGGT TCCCCCAGCC   600
```

TABLE 20-continued

```
CACAGTGGTC TGGGCATCCC AAGTTGACCA GGGAGCCAAC TTCTCGGAAG TCTCCAATAC    660

CAGCTTTGAG CTGAACTCTG AGAATGTGAC CATGAAGGTT GTGTCTGTGC TCTACAATGT    720

TACGATCAAC AACACATACT CCTGTATGAT TGAAAATGAC ATTGCCAAAG CAACAGGGGA    780

TATCAAAGTG ACAGAATCGG AGATCAAAAG GCGGAGTCAC CTACAGCTGC TAAACTCAAA    840

GGCTTCTCTG TGTGTCTCTT CTTTCTTTGC CATCAGCTGG GCACTTCTGC CTCTCAGCCC    900

TTACCTGATG CTAAAATAAT GTGCCTCGGC CACAAAAAAG CATGCAAAGT CATTGTTACA    960

ACAGGGATCT ACAGAACTAT TTCACCACCA GATATGACCT AGTTTTATAT TTCTGGGAGG   1020

AAATGAATTC ATATCTAGAA GTCTGGAGTG AGCAAACAAG AGCAAGAAAC AAAAAGAAGC   1080

CAAAAGCAGA AGGCTCCAAT ATGAACAAGA TAAATCTATC TTCAAAGACA TATTAGAAGT   1140

TGGGAAAATA ATTCATGTGA ACTAGAGTCA ACTGTGTCAG GCTAAGAAA  CCCTGGTTTT   1200

GAGTAGAAAA GGGCCTGGAA AGAGGGGAGC CAACAAATCT GTCTGCTTCC TCACATTAGT   1260

CATTGGCAAA TAAGCATTCT GTCTCTTTGG CTGCTGCCTC AGCACAGAGA GCCAGAACTC   1320

TATCGGGCAC CAGGATAACA TCTCTCAGTG AACAGAGTTG ACAAGGCCTA TGGGAAATGC   1380

CTGATGGGAT TATCTTCAGC TTGTTGAGCT TCTAAGTTTC TTTCCCTTCA TTCTACCCTG   1440

CAAGCCAAGT TCTGTAAGAG AAATGCCTGA GTTCTAGCTC AGGTTTTCTT ACTCTGAATT   1500

TAGATCTCCA GACCCTGCCT GGCCACAATT CAAATTAAGG CAACAAACAT ATACCTTCCA   1560

TGAAGCACAC ACAGACTTTT GAAAGCAAGG ACAATGACTG CTTGAATTGA GGCCTTGAGG   1620

AATGAAGCTT TGAAGGAAAA GAATACTTTG TTTCCAGCCC CCTTCCCACA CTCTTCATGT   1680

GTTAACCACT GCCTTCCTGG ACCTTGGAGC CACGCTGACT GTATTACATG TTGTTATAGA   1740

AAACTGATTT TAGAGTTCTG ATCGTTCAAG AGAATGATTA AATATACATT TCCTAAAAAA   1800

AAAAAAAAAA A

SEQ ID NO. 72 Protein sequence
Protein Accession #: NP_078902
1           11          21          31          41          51
|           |           |           |           |           |
MASLGQILFW  SIISIIIILA  GAIALIIGFG  ISGRHSITVT  TVASAGNIGE  DGILSCTFEP    60

DIKLSDIVIQ  WLKEGVLGLV  HEFKEGKDEL  SEQDEMFRGR  TAVFADQVIV  GNASLRLKNV   120

QLTDAGTYKC  YIITSKGKGN  ANLEYKTGAF  SMPEVNVDYN  ASSETLRCEA  PRWFPQPTVV   180

WASQVDQGAN  FSEVSNTSFE  LNSENVTMKV  VSVLYNVTIN  NTYSCMIEND  IAKATGDIKV   240

TESEIKRRSH  LQLLNSKASL  CVSSFFAISW  ALLPLSPYLM  LK

SEQ ID NO: 73 DNA sequence
Nucleic Acid Accession #: XM_057014
Coding sequence: 143..874
1           11          21          31          41          51
|           |           |           |           |           |
GGGAGGGAGA  GAGGCGCGCG  GGTGAAAGGC  GCATTGATGC  AGCCTGCGGC  GGCCTCGGAG    60

CGCGGCGGAG  CCAGACGCTG  ACCACGTTCC  TCTCCTCGGT  CTCCTCCGCC  TCCAGCTCCG   120

CGCTGCCCGG  CAGCCGGGAG  CCATGCGACC  CCAGGGCCCC  GCCGCCTCCC  CGCAGCGGCT   180

CCGCGGCCTC  CTGCTGCTCC  TGCTGCTGCA  GCTGCCCGCG  CCGTCGAGCG  CCTCTGAGAT   240

CCCCAAGGGG  AAGCAAAAGG  CGCAGCTCCG  GCAGAGGGAG  GTGGTGGACC  TGTATAATGG   300

AATGTGCTTA  CAAGGGCCAG  CAGGAGTGCC  TGGTCGAGAC  GGGAGCCCTG  GGCCAATGG    360

CATTCCGGGT  ACACCTGGGA  TCCCAGGTCG  GGATGGATTC  AAAGGAGAAA  AGGGGGAATG   420

TCTGAGGGAA  AGCTTTGAGG  AGTCCTGGAC  ACCCAACTAC  AAGCAGTGTT  CATGGAGTTC   480

ATTGAATTAT  GGCATAGATC  TTGGGAAAAT  TGCGGAGTGT  ACATTTACAA  AGATGCGTTC   540
```

TABLE 20-continued

```
AAATAGTGCT CTAAGAGTTT TGTTCAGTGG CTCACTTCGG CTAAAATGCA GAAATGCATG  600

CTGTCAGCGT TGGTATTTCA CATTCAATGG AGCTGAATGT TCAGGACCTC TTCCCATTGA  660

AGCTATAATT TATTTGGACC AAGGAAGCCC TGAAATGAAT TCAACAATTA ATATTCATCG  720

CACTTCTTCT GTGGAAGGAC TTTGTGAAGG AATTGGTGCT GGATTAGTGG ATGTTGCTAT  780

CTGGGTTGGC ACTTGTTCAG ATTACCCAAA AGGAGATGCT TCTACTGGAT GGAATTCAGT  840

TTCTCGCATC ATTATTGAAG AACTACCAAA ATAAATGCTT TAATTTTCAT TTGCTACCTC  900

TTTTTTTATT ATGCCTTGGA ATGGTTCACT TAAATGACAT TTTAAATAAG TTTATGTATA  980

CATCTGAATG AAAAGCAAAG CTAAATATGT TTACAGACCA AAGTGTGATT TCACACTGTT 1020

TTTAAATCTA GCATTATTCA TTTTGCTTCA ATCAAAAGTG GTTTCAATAT TTTTTTTAGT 1080

TGGTTAGAAT ACTTTCTTCA TAGTCACATT CTCTCAACCT ATAATTTGGA ATATTGTTGT 1140

GGTCTTTTGT TTTTTCTCTT AGTATAGCAT TTTTAAAAAA ATATAAAAGC TACCAATCTT 1200

TGTACAATTT GTAAATGTTA AGAATTTTTT TTATATCTGT TAAATAAAAA TTATTTCCAA 1260

CAACCTTAAA AAAAAAAAA AAAA

SEQ ID NO: 74 Protein sequence
Protein Accession #: XP_057014
1          11         21         31         41         51
|          |          |          |          |          |
MRPQGPAASP QRLRGLLLLL LLQLPAPSSA SEIPKGKQKA QLRQREVVDL YNGMCLQGPA  60

GVPGRDGSPG ANGIPGTPGI PGRDGFKGEK GECLRESFEE SWTPNYKQCS WSSLNYGIDL 120

GKIAECTFTK MRSNSALRVL FSGSLRLKCR NACCQRWYFT FNGAECSGPL PIEAIIYLDQ 180

GSPEMNSTIN IHRTSSVEGL CEGIGAGLVD VAIWVGTCSD YPKGDASTGW NSVSRIIIEE 240

LPK

SEQ ID NO: 75 DNA sequence
Nucleic Acid Accession #: BC010423
Coding sequence: 248. .1780
1          11         21         31         41         51
|          |          |          |          |          |
CACAGCGTGG GAAGCAGCTC TGGGGGAGCT CGGAGCTCCC GATCACGGCT TCTTGGGGGT  60

AGCTACGGCT GGGTGTGTAG AACGGGGCCG GGGCTGGGGC TGGGTCCCCT AGTGGAGACC 120

CAAGTGCGAG AGGCAAGAAC TCTGCAGCTT CCTGCCTTCT GGGTCAGTTC CTTATTCAAG 180

TCTGCAGCCG GCTCCCAGGG AGATCTCGGT GGAACTTCAG AAACGCTGGG CAGTCTGCCT 240

TTCAACCATG CCCCTGTCCC TGGGAGCCGA GATGTGGGGG CCTGAGGCCT GGCTGCTGCT 300

GCTGCTACTC CTGGCATCAT TTACAGGCCG GTGCCCCGCG GGTGAGCTGG AGACCTCAGA 360

CGTGGTAACT GTGGTGCTGG GCCAGGACGC AAAACTGCCC TGCTTCTACC GAGGGGACTC 420

CGGCGAGCAA GTGGGGCAAG TGGCATGGGC TCGGGTGGAC GCGGGCGAAG CGCCCAGGA 480

ACTAGCGCTA CTGCACTCCA AATACGGGCT TCATGTGAGC CCGGCTTACG AGGGCCGCGT 540

GGAGCAGCCG CCGCCCCCAC GCAACCCCCT GGACGGCTCA GTGCTCCTGC GCAACGCAGT 600

GCAGGCGGAT GAGGGCGAGT ACGAGTGCCG GGTCAGCACC TTCCCCGCCG GCAGCTTCCA 660

GGCGCGGCTG CGGCTCCGAG TGCTGGTGCC TCCCCTGCCC TCACTGAATC CTGGTCCAGC 720

ACTAGAAGAG GGCCAGGGCC TGACCCTGGC AGCCTCCTGC ACAGCTGAGG GCAGCCCAGC 780

CCCCAGCGTG ACCTGGGACA CGGAGGTCAA AGGCACAACG TCCAGCCGTT CCTTCAAGCA 840

CTCCCGCTCT GCTGCCGTCA CCTCAGAGTT CCACTTGGTG CCTAGCCGCA GCATGAATGG 900

GCAGCCACTG ACTTGTGTGG TGTCCCATCC TGGCCTGCTC CAGGACCAAA GGATCACCCA 960

CATCCTCCAC GTGTCCTTCC TTGCTGAGGC CTCTGTGAGG GGCCTTGAAG ACCAAAATCT 1020
```

TABLE 20-continued

```
GTGGCACATT GGCAGAGAAG GAGCTATGCT CAAGTGCCTG AGTGAAGGGC AGCCCCTCC   1080

CTCATACAAC TGGACACGGC TGGATGGGCC TCTGCCCAGT GGGGTACGAG TGGATGGGGA   1140

CACTTTGGGC TTTCCCCCAC TGACCACTGA GCACAGCGGC ATCTACGTCT GCCATGTCAG   1200

CAATGAGTTC TCCTCAAGGG ATTCTCAGGT CACTGTGGAT GTTCTTGACC CCAGGAAGA    1260

CTCTGGGAAG CAGGTGGACC TAGTGTCAGC CTCGGTGGTG GTGGTGGGTG TGATCGCCGC   1320

ACTCTTGTTC TGCCTTCTGG TGGTGGTGGT GGTGCTCATG TCCCGATACC ATCGGCGCAA   1380

GGCCCACCAG ATGACCCAGA AATATGAGGA GGAGCTGACC CTGACCAGGG AGAACTCCAT   1440

CCGGAGGCTG CATTCCCATC ACACGGACCC CAGGAGCCAG CCGGAGGAGA GTGTAGGGCT   1500

GAGAGCCGAG GGCCACCCTG ATAGTCTCAA GGACAACAGT AGCTGCTCTG TGATGAGTGA   1560

AGAGCCCGAG GGCCGCAGTT ACTCCACGCT GACCACGGTG AGGGAGATAG AAACACAGAC   1620

TGAACTGCTG TCTCCAGGCT CTGGGCGGGC CGAGGAGGAG GAAGATCAGG ATGAAGGCAT   1680

CAAACAGGCC ATGAACCATT TTGTTCAGGA GAATGGGACC CTACGGGCCA AGCCCACGGG   1740

CAATGGCATC TACATCAATG GGCGGGGACA CCTGGTCTGA CCCAGGCCTG CCTCCCTTCC   1800

CTAGGCCTGG CTCCTTCTGT TGACATGGGA GATTTTAGCT CATCTTGGGG GCCTCCTTAA   1860

ACACCCCCAT TTCTTGCGGA AGATGCTCCC CATCCCACTG ACTGCTTGAC CTTTACCTCC   1920

AACCCTTCTG TTCATCGGGA GGGCTCCACC AATTGAGTCT CTCCCACCAT GCATGCAGGT   1980

CACTGTGTGT GTGCATGTGT GCCTGTGTGA GTGTTGACTG ACTGTGTGTG TGTGGAGGGG   2040

TGACTGTCCG TGGAGGGGTG ACTGTGTCCG TGGTGTGTAT TATGCTGTCA TATCAGAGTC   2100

AAGTGAACTG TGGTGTATGT GCCACGGGAT TTGAGTGGTT GCGTGGGCAA CACTGTCAGG   2160

GTTTGGCGTG TGTGTCATGT GGCTGTGTGT GACCTCTGCC TGAAAAAGCA GGTATTTTCT   2220

CAGACCCCAG AGCAGTATTA ATGATGCAGA GGTTGGAGGA GAGAGGTGGA GACTGTGGCT   2280

CAGACCCAGG TGTGCGGGCA TAGCTGGAGC TGGAATCTGC CTCCGGTGTG AGGGAACCTG   2340

TCTCCTACCA CTTCGGAGCC ATGGGGGCAA GTGTGAAGCA GCCAGTCCCT GGGTCAGCCA   2400

GAGGCTTGAA CTGTTACAGA AGCCCTCTGC CCTCTGGTGG CCTCTGGGCC TGCTGCATGT   2460

ACATATTTTC TGTAAATATA CATGCGCCGG GAGCTTCTTG CAGGAATACT GCTCCGAATC   2520

ACTTTTAATT TTTTTCTTTT TTTTTTCTTG CCCTTTCCAT TAGTTGTATT TTTTATTTAT   2580

TTTTATTTTT ATTTTTTTTT AGAGTTTGAG TCCAGCCTGG ACGATATAGC CAGACCCTGT   2640

CTGTAAAAAA ACCAAAACCC AAAAAAAAAA AAAAAAAAA

SEQ ID NO: 76 Protein sequence
Protein Accession #: AAH10423
1           11          21          31          41          51
|           |           |           |           |           |
MPLSLGAEMW GPEAWLLLLL LLASFTGRCP AGELETSDVV TVVLGQDAKL PCFYRGDSGE    60

QVGQVAWARV DAGEGAQELA LLHSKYGLHV SPAYEGRVEQ PPPPRNPLDG SVLLRNAVQA   120

DEGEYECRVS TFPAGSFQAR LRLRVLVPPL PSLNPGPALE EGQGLTLAAS CTAEGSPAPS   180

VTWDTEVKGT TSSRSFKHSR SAAVTSEFHL VPSRSMNGQP LTCVVSHPGL LQDQRITHIL   240

HVSFLAEASV RGLEDQNLWH IGREGAMLKC LSEGQPPPSY NWTRLDGPLP SGVRVDGDTL   300

GFPPLTTEHS GIYVCHVSNE FSSRDSQVTV DVLDPQEDSG KQVDLVSASV VVVGVIAALL   360

FCLLVVVVVL MSRYHRRKAQ QMTQKYEEEL TLTRENSIRR LHSHHTDPRS QPEESVGLRA   420

EGHPDSLKDN SSCSVMSEEP EGRSYSTLTT VREIETQTEL LSPGSGRAEE EDQDEGIKQ    480

AMNHFVQENG TLRAKPTGNG IYINGRGHLV
```

TABLE 20-continued

SEQ ID NO: 77 DNA sequence
Nucleic Acid Accession #: NM_003474.2
Coding sequence 37. .3036

```
1          11         21         31         41         51
|          |          |          |          |          |
CACTAACGCT CTTCCTAGTC CCCGGGCCAA CTCGGACAGT TTGCTCATTT ATTGCAACGG  60

TCAAGGCTGG CTTGTGCCAG AACGGCGCGC GCGCGACGCA CGCACACACA CGGGGGGAAA 120

CTTTTTTAAA AATGAAAGGC TAGAAGAGCT CAGCGGCGGC GCGGGCCGTG CGCGAGGGCT 180

CCGGAGCTGA CTCGCCGAGG CAGGAAATCC CTCCGGTCGC GACGCCCGGC CCCGCTCGGC 240

GCCCGCGTGG GATGGTGCAG CGCTCGCCGC CGGGCCCGAG AGCTGCTGCA CTGAAGGCCG 300

GCGACGATGG CAGCGCGCCC GCTGCCCGTG TCCCCCGCCC GCGCCCTCCT GCTCGCCCTG 360

GCCGGTGCTC TGCTCGCGCC CTGCGAGGCC CGAGGGGTGA GCTTATGGAA CGAAGGAAGA 420

GCTGATGAAG TTGTCAGTGC CTCTGTTCGG AGTGGGGACC TCTGGATCCC AGTGAAGAGC 480

TTCGACTCCA AGAATCATCC AGAAGTGCTG AATATTCGAC TACAACGGGA AAGCAAAGAA 540

CTGATCATAA ATCTGGAAAG AAATGAAGGT CTCATTGCCA GCACTTTCAC GGAAACCCAC 600

TATCTGCAAG ACGGTACTGA TGTCTCCCTC GCTCGAAATT ACACGGTAAT TCTGGGTCAC 660

TGTTACTACC ATGGACATGT ACGGGGATAT TCTGATTCAG CAGTCAGTCT CAGCACGTGT 720

TCTGGTCTCA GGGACTTAT TGTGTTTGAA AATGAAAGCT ATGTCTTAGA ACCAATGAAA 700

AGTGCAACCA ACAGATACAA ACTCTTCCCA GCGAAGAAGC TGAAAAGCGT CCGGGGATCA 840

TGTGGATCAC ATCACAACAC ACCAAACCTC GCTGCAAAGA ATGTGTTTCC ACCACCCTCT 900

CAGACATGGG CAAGAAGGCA TAAAAGAGAG ACCCTCAAGG CAACTAAGTA TGTGGAGCTG 960

GTGATCGTGG CAGACAACCG AGAGTTTCAG AGGCAAGGAA AAGATCTGGA AAAAGTTAAG 1020

CAGCGATTAA TAGAGATTGC TAATCACGTT GACAAGTTTT ACAGACCACT GAACATTCGG 1080

ATCGTGTTGG TAGGCGTGGA AGTGTGGAAT GACATGGACA AATGCTCTGT AAGTCAGGAC 1140

CCATTCACCA GCCTCCATGA ATTTCTGGAC TGGAGGAAGA TGAAGCTTCT ACCTCGCAAA 1200

TCCCATGACA ATGCGCAGCT TGTCAGTGGG GTTTATTTCC AAGGGACCAC CATCGGCATG 1260

GCCCCAATCA TGAGCATGTG CACCGCACAC CAGTCTGGGG AATTGTCAT GGACCATTCA 1320

GACAATCCCC TTGGTGCAGC CGTGACCCTG GCACATGACC TGGGCCACAA TTTCGGGATG 1300

AATCATGACA CACTGGACAG GGGCTGTAGC TGTCAAATGG CCGTTGAGAA AGGAGGCTGC 1440

ATCATGAACG CTTCCACCGG GTACCCATTT CCCATGGTGT TCAGCACTTG CAGCAGGAAG 1500

GACTTGGAGA CCAGCCTGGA GAAAGGAATG GGGGTGTGCC TGTTTAACCT GCCGGAAGTC 1560

AGGGAGTCTT TCGGGGCCA GAAGTGTGGG AACAGATTTG TGGAAGAAGG AGAGGAGTGT 1620

GACTGTGGGG AGCCAGAGGA ATGTATGAAT CGCTGCTGCA ATGCCACCAC CTGTACCCTG 1680

AAGCCGGACG CTGTGTGCGC ACATGGGCTG TGCTGTGAAG ACTGCCAGCT GAAGCCTGCA 1740

GGAACAGCGT GCAGGGACTC CAGCAACTCC TGTGACCTCC CAGAGTTCTG CACAGGGGCC 1800

AGCCCTCACT GCCCAGCCAA CGTGTACCTG CACGATGGGC ACTCATGTCA GGATGTGGAC 1860

GGCTACTGCT ACAATGGCAT CTGCCAGACT CACGAGCAGC AGTGTGTCAC ACTCTGGGGA 1920

CCAGGTGCTA AACCTGCCCC TGGGATCTGC TTTGAGAGAG TCAATTCTGC AGGTGATCCT 1980

TATGGCAACT GTGGCAAAGT CTCGAAGAGT TCCTTTGCCA AATGCGAGAT GAGAGATGCT 2040

AAATGTGGAA AAATCCAGTG TCAAGGAGGT GCCAGCCGGC CAGTCATTGG TACCAATGCC 2100

GTTTCCATAG AAACAAACAT CCCCCTGCAG CAAGGAGGCC GGATTCTGTG CCGGGGGACC 2160

CACGTGTACT TGGGCGATGA CATGCCGGAC CCAGGGCTTG TGCTTGCAGG CACAAAGTGT 2220
```

TABLE 20-continued

```
GCAGATGGAA AAATCTGCCT GAATCGTCAA TGTCAAAATA TTAGTGTCTT TGGGGTTCAC 2280
GAGTGTGCAA TGCAGTGCCA CGGCAGAGGG GTGTGCAACA ACAGGAAGAA CTGCCACTGC 2340
GAGGCCCACT GGGCACCTCC CTTCTGTGAC AAGTTTGGCT TTGGAGGAAG CACAGACAGC 2400
GGCCCCATCC GGCAAGCAGA TAACCAAGGT TTAACCATAG GAATTCTGGT GACCATCCTG 2460
TGTCTTCTTG CTGCCGGATT TGTGGTTTAT CTCAAAAGGA AGACCTTGAT ACGACTGCTG 2520
TTTACAAATA AGAAGACCAC CATTGAAAAA CTAAGGTGTG TGCGCCCTTC CCGGCCACCC 2580
CGTGGCTTCC AACCCTGTCA GGCTCACCTC GGCCACCTTG GAAAAGGCCT GATGAGGAAG 2640
CCGCCAGATT CCTACCCACC GAAGGACAAT CCCAGGAGAT TGCTGCAGTG TCAGAATCTT 2700
GACATCAGCA GACCCCTCAA CGGCCTGAAT GTCCCTCAGC CCAGTCAAC TCAGCGAGTG 2760
CTTCCTCCCC TCCACCGGGC CCCACGTGCA CCTAGCGTCC CTGCCAGACC CCTGCCAGCC 2820
AAGCCTGCAC TTAGGCAGGC CCAGGGGACC TGTAAGCCAA ACCCCCCTCA GAAGCCTCTG 2880
CCTGCAGATC CTCTGGCCAG AACAACTCGG CTCACTCATG CCTTGGCCAG GACCCCAGGA 2940
CAATGGGAGA CTGGGCTCCG CCTGGCACCC CTCAGACCTG CTCCACAATA TCCACACCAA 3000
GTGCCCAGAT CCACCCACAC CGCCTATATT AAGTGAGAAG CCGACACCTT TTTTCAACAG 3060
TGAAGACAGA AGTTTGCACT ATCTTTCAGC TCCAGTTGGA GTTTTTTGTA CCAACTTTTA 3120
GGATTTTTTT TAATGTTTAA AACATCATTA CTATAAGAAC TTTGAGCTAC TGCCGTCAGT 3180
GCTGTGCTGT GCTATGGTGC TCTGTCTACT TGCACAGGTA CTTGTAAATT ATTAATTTAT 3240
GCAGAATGTT GATTACAGTG CAGTGCGCTG TAGTAGGCAT TTTTACCATC ACTGAGTTTT 3300
CCATGGCAGG AAGGCTTGTT GTGCTTTTAG TATTTTAGTG AACTTGAAAT ATCCTGCTTG 3360
ATGGGATTCT GGACAGGATG TGTTTGCTTT CTGATCAAGG CCTTATTGGA AAGCAGTCCC 3420
CCAACTACCC CCAGCTGTGC TTATGGTACC AGATGCAGCT CAAGAGATCC CAAGTAGAAT 3480
CTCAGTTGAT TTTCTGGATT CCCCATCTCA GGCCAGAGCC AAGGGGCTTC AGGTCCAGGC 3540
TGTGTTTGGC TTTCAGGGAG GCCCTGTGCC CCTTGACAAC TGGCAGGCAG GCTCCCAGGG 3600
ACACCTGGGA GAAATCTGGC TTCTGGCCAG GAAGCTTTGG TGAGAACCTG GGTTGCAGAC 3660
AGGAATCTTA AGGTGTAGCC ACACCAGGAT AGAGACTGGA ACACTAGACA AGCCAGAACT 3720
TGACCCTGAG CTGACCAGCC GTGAGCATGT TTGGAAGGGG TCTGTAGTGT CACTCAAGGC 3780
GGTGCTTGAT AGAAATGCCA AGCACTTCTT TTTCTCGCTG TCCTTTCTAG AGCACTGCCA 3840
CCAGTAGGTT ATTTAGCTTG GGAAAGGTGG TGTTTCTGTA AGAAACCTAC TGCCCAGGCA 3900
CTGCAAACCG CCACCTCCCT ATACTGCTTG GAGCTGAGCA AATCACCACA AACTGTAATA 3960
CAATGATCCT GTATTCAGAC AGATGAGGAC TTTCCATGGG ACCACAACTA TTTTCAGATG 4020
TGAACCATTA ACCAGATCTA GTCAATCAAG TCTGTTTACT GCAAGGTTCA ACTTATTAAC 4080
AATTAGGCAG ACTCTTTATG CTTGCAAAAA CTACAACCAA TGGAATGTGA TGTTCATGGG 4140
TATAGTTCAT GTCTGCTATC ATTATTCGTA GATATTGGAC AAAGAACCTT CTCTATGGGG 4200
CATCCTCTTT TTCCAACTTG GCTGCAGGAA TCTTTAAAAG ATGCTTTTAA CAGAGTCTGA 4260
ACCTATTTCT TAAACACTTG CAACCTACCT GTTGAGCATC ACAGAATGTG ATAAGGAAAT 4320
CAACTTGCTT ATCAACTTCC TAAATATTAT GAGATGTGGC TTGGGCAGCA TCCCCTTGAA 4380
CTCTTCACTC TTCAAATGCC TGACTAGGGA GCCATGTTTC ACAAGGTCTT TAAAGTGACT 4440
AATGGCATGA GAAATACAAA AATACTCAGA TAAGGTAAAA TGCCATGATG CCTCTGTCTT 4500
CTGGACTGGT TTTCACATTA GAAGACAATT GACAACAGTT ACATAATTCA CTCTGAGTGT 4560
TTTATGAGAA AGCCTTCTTT TGGGGTCAAC AGTTTTCCTA TGCTTTGAAA CAGAAAAATA 4620
```

TABLE 20-continued

```
TGTACCAAGA ATCTTGGTTT GCCTTCCAGA AAACAAAACT GCATTTCACT TTCCCGGTGT 4680

TCCCCACTGT ATCTAGGCAA CATAGTATTC ATGACTATGG ATAAACTAAA CACGTGACAC 4740

AAACACACAC AAAAGGGAAC CCAGCTCTAA TACATTCCAA CTCGTATAGC ATGCATCTGT 4800

TTATTCTATA GTTATTAAGT TCTTTAAAAT GTAAAGCCAT GCTGGAAAAT AATACTGCTG 4860

AGATACATAC AGAATTACTG TAACTGATTA CACTTGGTAA TTGTACTAAA GCCAAACATA 4920

TATATACTAT TAAAAAGGTT TACAGAATTT TATGGTGCAT TACGTGGGCA TTGTCTTTTT 4980

AGATGCCCAA ATCCTTAGAT CTGGCATGTT AGCCCTTCCT CCAATTATAA GAGGATATGA 5040

ACCAAAAAAA AAAAAAAAA AA

SEQ ID NO. 78 Protein sequence
Protein Accession #: NP_003465
1          11         21         31         41         51
|          |          |          |          |          |
MAARPLPVSP ARALLLALAG ALLAPCEARG VSLWNEGRAD EVVSASVRSG DLWIPVKSFD  60

SKNHPEVLNI RLQRESKELI INLERNEGLI ASSFTETHYL QDGTDVSLAR NYTVILGHCY 120

YHGHVRGYSD SAVSLSTCSG LRGLIVFENE SYVLEPMKSA TNRYKLFPAK KLKSVRGSCG 180

SHHNTPNLAA KNVFPPPSQT WARRHKRETL KATKYVELVI VADNREFQRQ GKDLEKVKQR 240

LIEIANHVDK FYRPLNIRIV LVGVEVWNDM DKCSVSQDPF TSLHEFLDWR KMKLLPRKSH 300

DNAQLVSGVY FQGTTIGMAP IMSMCTADQS GGIVMDHSDN PLGAAVTLAH ELGHNFGMNH 360

DTLDRGCSCQ MAVEKGGCIM NASTGYPFPM VFSSCSRKDL ETSLEKGMGV CLFNLPEVRE 420

SFGGQKCGNR FVEEGEECDC GEPEECMNRC CNATTCTLKP DAVCAHGLCC EDCQLKPAGT 480

ACRDSSNSCD LPEFCTGASP HCPANVYLHD GHSCQDVDGY CYNGICQTHE QQCVTLWGPG 540

AKPAPGICFE RVNSAGDPYG NCGKVSKSSF AKCEMRDAKC GKIQCQGGAS RPVIGTNAVS 600

IETNIPLQQG GRILCRGTHV YLGDDMPDPG LVLAGTKCAD GKICLNRQCQ NISVFGVHEC 660

AMQCHGRGVC NNRKNCHCEA HWAPPFCDKF GFGGSTDSGP IRQADNQGLT IGILVTILCL 720

LAAGFVVYLK RKTLIRLLFT NKKTTIEKLR CVRPSRPPRG FQPCQAHLGN LGKGLMRKPP 780

DSYPPKDNPR RLLQCQNVDI SRPLNGLNVP QPQSTQRVLP PLHRAPRAPS VPARPLPAKP 840

ALRQAQGTCK PNPPQKPLPA DPLARTTRLT HALARTPGQW ETGLRLAPLR PAPQYPHQVP 900

RSTNTAYIK

SEQ ID NO: 79 DNA sequence
Nucleic Acid Accession #: NN_003714
Coding sequence: 135..1043
1          11         21         31         41         51
|          |          |          |          |          |
GAGGAGGAGG GAAAAGGCGA GCAAAAAGGA AGAGTGGGAG GAGGAGGGGA AGCGGCGAAG  60

GAGGAAGAGG AGGAGGAGGA AGAGGGGAGC ACAAAGGATC CAGGTCTCCC GACGGGAGGT 120

TAATACCAAG AACCATGTGT GCCGAGCGGC TGGGCCAGIT CATGACCCTG GCTTTGGTGT 180

TGGCCACCTT TGACCCGGCG CGGGGGACCG ACGCCACCAA CCCACCCGAG GGTCCCCAAG 240

ACAGGAGCTC CCAGCAGAAA GGCCGCCTGT CCCTGCAGAA TACAGCGGAG ATCCAGCACT 300

GTTTGGTCAA CGCTGGCGAT GTGGGGTGTG GCGTGTTTGA ATGTTTCGAG AACAACTCTT 360

GTGAGATTCG GGGCTTACAT GGGATTTGCA TGACTTTTCT GCACAACGCT GGAAAATTTG 420

ATGCCCAGGG CAAGTCATTC ATCAAAGACG CCTTGAAATG TAAGGCCCAC GCTCTGCGGC 480

ACAGGTTCGG CTGCATAAGC CGGAAGTGCC CGGCCATCAG GGAAATGGTG TCCCAGTTGC 540

AGCGGGAATG CTACCTCAAG CACGACCTGT GCGCGGCTGC CCAGGAGAAC ACCCGGGTGA 600

TAGTGGAGAT GATCCATTTC AAGGACTTGC TGCTGCACGA ACCCTACGTG GACCTCGTGA 660
```

TABLE 20-continued

```
ACTTGCTGCT GACCTGTGGG GAGGAGGTGA AGGAGGCCAT CACCCACAGC GTGCAGGTTC  720

AGTGTGAGCA GAACTGGGGA AGCCTGTGCT CCATCTTGAG CTTCTGCACC TCGGCCATCC  780

AGAAGCCTCC CACGGCGCCC CCCGAGCGCC AGCCCCAGGT GGACAGAACC AAGCTCTCCA  840

GGGCCCACCA CGGGGAAGCA GGACATCACC TCCCAGAGCC CAGCACTAGG GAGACTGGCC  900

GAGGTGCCAA GGGTGAGCGA GGTAGCAAGA GCCACCCAAA CGCCCATGCC CGAGGCAGAG  960

TCGGGGGCCT TGGGGCTCAG GGACCTTCCG GAAGCAGCGA GTGGGAAGAC GAACAGTCTG 1020

AGTATTCTGA TATCCGGAGG TGAAATGAAA GGCCTGGCCA CGAAATCTTT CCTCCACGCC 1080

GTCCATTTTC TTATCTATGG ACATTCCAAA ACATTTACCA TTAGAGAGGG GGGATGTCAC 1140

ACGCAGGATT CTGTGGGGAC TGTGGACTTC ATCGAGGTGT GTGTTCGCGG AACGGACAGG 1200

TGAGATGGAG ACCCCTGGGG CCGTGGGGTC TCAGGGGTGC CTGGTGAATT CTGCACTTAC 1260

ACGTACTCAA GGGAGCGCGC CCGCGTTATC CTCGTACCTT TGTCTTCTTT CCATCTGTGG 1320

AGTCAGTGGG TGTCGGCCGC TCTGTTGTGG GGGAGGTGAA CCAGGGAGGG GCAGGGCAAG 1380

GCAGGGCCCC CAGAGCTGGG CCACACAGTG GGTGCTGGGC CTCGCCCCGA AGCTTCTGGT 1440

GCAGCAGCCT CTGGTGCTGT CTCCGCGGAA GTCAGGGCGG CTGGATTCCA GGACAGGAGT 1500

GAATGTAAAA ATAAATATCG CTTAGAATGC AGGAGAAGGG TGGAGAGGAG GCAGGGGCCG 1560

AGGGGGTGCT TGGTGCCAAA CTGAAATTCA GTTTCTTGTG TGGGGCCTTG CGGTTCAGAG 1620

CTCTTGGCGA GGGTGGAGGG AGGAGTGTCA TTTCTATGTG TAATTTCTGA GCCATTGTAC 1680

TGTCTGGGCT GGGGGGGACA CTGTCCAAGG GAGTGGCCCC TATGAGTTTA TATTTTAACC 1740

ACTGCTTCAA ATCTCGATTT CACTTTTTTT ATTTATCCAG TTATATCTAC ATATCTGTCA 1800

TCTAAATAAA TGGCTTTCAA ACAAAGCAAC TGGGTCATTA AAACCAGCTC AAAGGCGGTT 1860

TAAAAAAAAA AAAACCAGCC CATCCTTTGA GGCTGATTTT TCTTTTTTTT AAGTTCTATT 1920

TTAAAAGCTA TCAAACAGCG ACATAGCCAT ACATCTGACT GCCTGACATG GACTCCTGCC 1980

CACTTGGGGG AAACCTTATA CCCAGAGGAA AATACACACC TGGGGAGTAC ATTTGACAAA 2040

TTTCCCTTAG GATTTCGTTA TCTCACCTTG ACCCTCAGCC AAGATTGGTA AAGCTGCGTC 2100

CTGGCGATTC CAGGAGACCC AGCTGGAAAC CTGGCTTCTC CATGTGAGGG GATGGGAAAG 2160

GAAAGAAGAG AATGAAGACT ACTTAGTAAT TCCCATCAGG AAATGCTGAC CTTTTACATA 2220

AAATCAAGGA GACTGCTGAA AATCTCTAAG GGACAGGATT TTCCAGATCC TAATTGGAAA 2280

TTTAGCAATA AGGAGAGGAG TCCAAGGGGA CAAATAAAGG CAGAGAGAGA GAGAGAGAGA 2340

GGGAGAGGAA GAAAAGAGAG AGAGAAAAGA GCCTCGTGCC
```

SEQ ID NO. 80 Protein sequence
Protein Accession #: NP_003705

```
1          11         21         31         41         51
|          |          |          |          |          |
MCAERLGQPM TLALVLATFD PARGTDATNP PEGPQDRSSQ QKGRLSLQNT AEIQHCLVNA  60

GDVGCGVFEC FENNSCEIRG LHGICMTFLH NAGKFDAQGK SFIKDALKCK AHALRHRFGC 120

ISRKCPAIRE MVSQLQRECY LKHDLCAAAQ ENTRVIVEMI HFKDLLLHEP YVDLVNLLLT 180

CGEEVKEAIT NSVQVQCEQN WGSLCSILSF CTSAIQKPPT APPERQPQVD RTKLSRAHHG 240

EAGHHLPEPS SRETGRGAKG ERGSKSHPNA HARGRVGGLG AQGPSGSSEW EDEQSEYSDI 300

RN
```

TABLE 20-continued

SEQ ID NO: 81 DNA sequence
Nucleic Acid Accession #: CAT cluster

```
1          11         21         31         41         51
|          |          |          |          |          |
AATCATGTTT TTGGAATAAA AATGGTAAAT GTTTTTTTTT TTTTTTTTTT GTTAGTAATG  60
GAAGTATTCT ATTATTTTTA ATTTTATGTA TGTACAGACA AGAGCTATAT GGGAAAGTAG 120
CTATTACAGA CCCATTATAG TTTCATCATT TATAACCAGC GTTGGTAGTA AAGCAACAGA 180
AATACATCTT CAATGCAGAC TTGCTCCCAG CATCTCTTTC CTTTCATCCT TGACCATATT 240
GCATCCTGGA CAGCAAGAAG ACATCCTCAG CCCACCACCC CTTCCCCTCC AATGTCGACT 300
GAGTGTTGGG TCAACTGATA AGCAGTGCAG ACTCTTCATT TTGCTTTGTT GGTGCCTTCG 360
AGGCATGTGA GGGCACAGCC TCAAATTCCA GAGACCTTGC CTTCAGGATT TGAGGTGGGC 420
AAAGATGTGA AGAAGACCT TTAGCCACTC AGTGTTATCA AAAGCAATCA CCAAAGAAGT 480
TTTTGCATCT GGCATTGTGT TGGGACGTCC ATCAGCAGTA CCGTACGGTC TCTTTACTGG 540
ACAAGTATTT ACACCTTGTT AACAGCAGTG TACACCCGGT GGAAAACTCC TATCTAATGC 600
CATGGCAGAA TTGTAAACAT TTCCTCCTTC ACCAAATTTC TGGATGGAAT AAACATGTAC 660
CCTTAAACTT TATTGGCTTC TCCGGTCTTG CCACTGCGGG GCCCAAAAAC TTTCAGAAGT 720
AGGAATCCTG TGGCATCTGC TAATGGTGAT TGGAAGAAAG AGTAGAGGTG ACAGTATCTA 780
TGGCTGCAGT ACCAGAACTA TTACGAAATG TTCCAGCTGC GATTTCACAG GAATCCCCCC 840
TGACCCCTCG ACGTGGTTCT CCTATTTCAG TCACCCTGTG CCC
```

SEQ ID NO: 82 DNA sequence
Nucleic Acid Accession #. XM_061091.1
Coding sequence: 1. .2481

```
1          11         21         31         41         51
|          |          |          |          |          |
ATGCCAAATA CTTCAGGAAC AACCAGGATT GAAATTTGGC TTCTCCAAGA GCCGCCCGGG  60
CACCGACCGC TGGTCGCCGC TCTCCTTCCG GTGAGTCCCA GCCCCGAGTT GGCTCTGGCG 120
CCCGGGTACC CGCCAGTGCC GGCTGCCGAT GACCGATTCA CGCTCCCGAT GATTGGAGGT 180
CAGATGCATG GTGAGAAGGT AGATCTCTGG AGCCTTGGTG TTCTTTGCTA TGAATTTTTA 240
GTTGGGAAGC CTCCTTTTGA GGCAAACGAA GTCCATGTAA GCAAAGAAAC CATCGGGAAG 300
ATTTCAGCTC CCAGCAAAAT GATGTGGTGC TCGGCTGCAG TGGACATCAT GTTTCTGTTA 360
GATGGGTCTA ACAGCGTCGG GAAAGGGAGC TTTGAAAGGT CCAAGCACTT TGCCATCACA 420
GTCTGTGACG GTCTGGACAT CAGCCCCGAG AGGGTCAGAG TGGGAGCATT CCAGTTCAGT 480
TCCACTCCTC ATCGGAATT CCCCTTGGAT TCATTTTCAA CCCAACAGGA AGTGAAGGCA 540
AGAATCAAGA GGATGGTTTT CAAAGGAGGG CGCACGGAGA CGGAACTTGC TCTGAAATAC 600
CTTCTGCACA GAGGGTTGCC TGGAGGCAGA AATGCTTCTG TGCCCCAGAT CCTCATCATC 660
GTCACTGATG GGAAGTCCCA GGGGGATGTG GCACTGCCAT CCAAGCAGCT GAAGGAAAGG 720
GGTGTCACTG TGTTTGCTGT GGGGGTCAGG TTTCCCAGGT GGGAGGAGCT GCATGCACTG 780
GCCAGCGAGC CTAGAGGGCA GCACGTGCTG TTGGCTGAGC AGGTGGAGGA TGCCACCAAC 840
GGCCTCTTCA GCACCCTCAG CAGCTCGGCC ATCTGCTCCA GCGCCACGCC AGCTGGGAGC 900
CCCGAGCTTG TCTTCATGGA GCGGTTAATG GGCATCTCTC TGATAGGCCC CTGTGACTCG 960
CAGCCCTGCC AGAATGGAGG CACATGTGTT CCAGAAGGAC TGGACCGCTA CCAGTGCCTC 1020
TGCCCGCTGG CCTTTGGAGG GGAGGCTAAC TGTGCCCTGA AGCTGAGCCT GGAATGCAGG 1080
GTCGACCTCC TCTTCCTGCT GGACAGCTCT GCGGGCACCA CTCTGGACGG CTTCCTGCGG 1140
GCCAAAGTCT TCGTGAAGCG GTTTGTGCGG GCCGTGCTGA GCGAGGACTC TCGGGCCCGA 1200
```

TABLE 20-continued

```
GTGGGTGTGG CCACATACAG CAGGGAGCTG CTGGTGGCGG TGCCTGTGGG GGACTACCAG  1260

GATGTGCCTG ACCTGGTCTG GAGCCTCGAT GGCATTCCCT TCCGTGGTGG CCCCACCCTG  1320

ACGGGCAGTG CCTTGCGGCA GGCCGCAGAG CGTGGCTTCG GGAGCGCCAC CAGGACAGGC  1380

CAGGACCGGC CACGTAGAGT GGTGGTTTTG CTCACTGAGT CACACTCCGA GGATGAGGTT  1440

GCGGGCCCAG CGCGTCACGC AAGGGCGCGA GAGCTGCTCC TGCTGGGTGT AGGCAGTGAG  1500

GCCGTGCGGG CAGAGCTGGA GGAGATCACA GGCAGCCCAA AGCATGTGAT GGTCTACTCG  1560

GATCCTCAGG ATCTGTTCAA CCAAATCCCT GAGCTGCAGG GGAAGCTGTG CAGCCGGCAG  1620

CGGCCAGGGT GCCGGACACA AGCCCTGGAC CTCGTCTTCA TGTTGGACAC CTCTGCCTCA  1680

GTAGGGCCCG AGAATTTTGC TCAGATGCAG AGCTTTGTGA AAGCTGTGC CCTCCAGTTT  1740

GAGGTGAACC CTGACGTGAC ACAGGTCGGC CTGGTGGTGT ATGGCAGCCA GGTGCAGACT  1800

GCCTTCGGGC TGGACACCAA ACCCACCCGG GCTGCGATGC TGCGGGCCAT TAGCCAGGCC  1860

CCCTACCTAG GTGGGGTGGG CTCAGCCGGC ACCGCCCTGC TGCACATCTA TGACAAACTG  1920

ATGACCGTCC AGAGGGGTGC CCGGCCTGGT GTCCCCAAAG CTGTGGTGGT GCTCACAGGC  1980

GGGAGAGGCG CAGAGGATGC AGCCGTTCCT GCCCAGAAGC TGAGGAACAA TGGCATCTCT  2040

GTCTTGGTCG TGGGCGTGGG GCCTGTCCTA AGTGAGGGTC TGCGGAGGCT TGCAGGTCCC  2100

CGGGATTCCC TGATCCACGT GGCAGCTTAC GCCGACCTGC GGTACCACCA GGACGTGCTC  2160

ATTGAGTGGC TGTGTGGAGA AGCCAAGCAG CCAGTCAACC TCTGCAAACC CAGCCCGTGC  2220

ATGAATGAGG GCAGCTGCGT CCTGCAGAAT GGGAGCTACC GCTGCAAGTG TCGGGATGGC  2280

TGGGAGGGCC CCCACTGCGA GAACCGTGAG TGGAGCTCTT GCTCTGTATG TGTGAGCCAG  2340

GGATGGATTC TTGAGACGCC CCTGAGGCAC ATGGCTCCCG TGCAGGAGGG CAGCAGCCGT  2400

ACCCCTCCCA GCAACTACAG AGAAGGCCTG GGCACTGAAA TGGTGCCTAC CTTCTGGAAT  2460

GTCTGTGCCC CAGGTCCTTA G
```

SEQ ID NO: 83 Protein sequence
Protein Accession #: XP_061091.1

```
1          11         21         31         41         51
|          |          |          |          |          |
MPNTSGTTRI EIWLLQEPPG HRALVAALLP VSPSPELALA PGYPPVPAAD DRFTLPMIGG   60

QMHGEKVDLW SLGVLCYEFL VGKPPFEANE VHVSKETIGK ISAASKMMWC SAAVDIMFLL  120

DGSNSVGKGS FERSKNFAIT VCDGLDISPE RVRVGAFQFS STPHLEFPLD SFSTQQEVKA  180

RIKRMVFKGG RTETELALKY LLHRGLPGGR NASVPQILII VTDGKSQGDV ALPSKQLKER  240

GVTVFAVGVR FPRWEELHAL ASEPRGQHVL LAEQVEDATN GLFETLSSSA ICSSATPAGS  300

PELVFMERLM GISLIGPCDS QPCQNGGTCV PEGLDGYQCL CPLAFGGEAN CALKLSLECR  360

VDLLFLLDSS AGTTLDGFLR AKVFVKRFVR AVLSEDSRAR VGVATYSREL LVAVPVCEYQ  420

DVPDLVWSLD GIPFRGGPTL TGSALRQAAE RGFGSATRTG QDRPRRVVVL LTESHSEDEV  480

AGPARHARAR ELLLLGVGSE AVRAELEEIT GSPKHVMVYS DPQDLFNQIP ELQCKLCSRQ  540

RPGCRTQALD LVFNLDTSAS VGPENFAQMQ SPVRSCALQF EVNPDVTQVG LVVYGSQVQT  600

AFGLDTKPTR AAMLRAISQA PYLGGVGSAG TALLHIYDKV MTVQRGARPG VPKAVVVLTG  660

GRGAEDAAVP AQKLRNNGIS VLVVGVGPVL SEGLRRLAGP RDSLIHVAAY ADLRYHQDVL  720

IEWLCGEAKQ PVNLCKPSPC MNEGSCVLQN GSYRCKCRDG WEGPHCENRE WSSCSVCVSQ  780

GWILETPLRH MAPVQEGSSR TPPSNYREGL GTEMVPTFWN VCAPGP
```

TABLE 20-continued

```
SEQ ID NO: 84 DNA sequence
Nucleic Acid Accession #: Eos sequence
Coding sequence: 1. .2424
1          11         21         31         41         51
|          |          |          |          |          |
ATGCCCCTT  TCCTGTTGCT GGAGGCCGTC TGTGTTTTCC TGTTTTCCAG AGTGCCCCCA  60

TCTCTCCCTC TCCAGGAACT CCATGTAAGC AAAGAAACCA TCGGGAAGAT TTCAGCTGCC  120

AGCAAAATGA TGTGGTCCTC GGCTGCACTG ACATCATGT  TTCTGTTAGA TGGGTCTAAC  180

AGCGTCGGGA AAGGGAGCTT TGAAAGGTCC AAGCACTTTG CCATCACAGT CTGTGACGGT  240

CTGGACATCA GCCCCGAGAG GGTCAGAGTC GGAGCATTCC AGTTCAGTTC CACTCCTCAT  300

CTGGAATTCC CCTTGGATTC ATTTTCAACC CAACAGGAAG TGAAGGCAAG AATCAAGAGG  360

ATGGTTTTCA AAGGAGGGCG CACCGAGACG GAACTTGCTC TGAAATACCT TCTGCACAGA  420

GGGTTGCCTG GAGGCAGAAA TGCTTCTGTG CCCCAGATCC TCATCATCGT CACTGATGGG  480

AAGTCCCAGG GGGATGTGGC ACTGCCATCC AAGCAGCTGA AGGAAAGGGG TGTCACTGTG  540

TTTGCTGTGG GGGTCAGGTT TCCCAGGTGG GAGGAGCTGC ATGCACTGGC CAGCGAGCCT  600

AGAGGGCAGC ACGTGCTGTT GGCTGAGCAG GTGGAGGATG CCACCAACGG CCTCTTCAGC  660

ACCCTCAGCA GCTCGGCCAT CTGCTCCAGC GCCACGCCAG ACTGCAGGGT CGAGGCTCAC  720

CCCTGTGAGC ACAGGACGCT GGAGATGGTC CGGGAGTTCG CTGGCAATGC CCATGCTGG   780

AGAGGATCGC GGCGGACCCT TGCGGTGCTG GCTGCACACT GTCCCTTCTA CAGCTGGAAG  840

AGAGTGTTCC TAACCCACCC TGCCACCTGC TACAGGACCA CCTGCCCAGG CCCCTGTGAC  900

TCGCAGCCCT GCCAGAATGG AGGCACATGT GTTCCAGAAG GACTGGACGG CTACCAGTGC  960

CTCTGCCCGC TGGCCTTTGG AGGGGAGGCT AACTGTGCCC TGAAGCTGAG CCTGGAATGC  1020

AGGGTCGACC TCCTCTTCCT GCTGGACAGC TCTGCGGGCA CCACTCTGGA CGGCTTCCTG  1080

CGGGCCAAAG TCTTCGTGAA GCGGTTTGTG CGGGCCGTGC TGAGCGAGGA CTCTCGGGCC  1140

CGAGTGGGTG TGGCCACATA CACCAGGGAG CTGCTGGTGG CGGTGCCTGT GGGGGAGTAC  1200

CAGGATGTGC CTGACCTGGT CTGGAGCCTC GATGGCATTC CCTTCCGTGG TGGCCCCACC  1260

CTGACGGGCA GTGCCTTGCG GCAGGCGGCA GAGCGTGGCT TCGGGAGCGC CACCAGGACA  1320

GGCCAGGACC GGCCACGTAG AGTGGTGGTT TTGCTCACTG AGTCACACTC CGAGGATGAG  1380

GTTGCGGGCC CAGCGCGTCA CGCAAGGGCG CGAGAGCTGC TCCTGCTGGG TGTAGGCAGT  1440

GAGGCCGTGC GGGCAGAGCT GGAGGAGATC ACAGGCAGCC AAAGCATGT  GATGGTCTAC  1500

TCGGATCCTC AGGATCTGTT CAACCAAATC CCTGAGCTGC AGGGGAAGCT GTGCAGCCGG  1560

CAGCGGCCAG GGTGCCGGAC ACAAGCCCTG GACCTCGTCT TCATGTTGGA CACCTCTGCC  1620

TCAGTAGGGC CCGAGAATTT TGCTCAGATG CAGAGCTTTG TGAGAAGCTG TGCCCTCCAG  1680

TTTGAGGTGA CCCTGACGT  GACACAGGTC GGCCTGGTGG TGTATGGCAG CCAGGTGCAG  1740

ACTGCCTTCG GCTGGACAC  CAAACCCACC CGGGCTGCGA TGCTGCGGGC CATTAGCCAG  1800

GCCCCCTACC TAGGTGGGGT GGGCTCAGCC GGCACCGCCC TGCTGCACAT CTATGACAAA  1860

GTGATGACCG TCCAGAGGGG TGCCCGGCCT GGTGTCCCCA AGCTGTGGT  GGTGCTCACA  1920

GGCGGGAGAG GCGCAGAGGA TGCAGCCGTT CCTGCCCAGA AGCTGAGGAA CAATGGCATC  1980

TCTGTCTTGG TCGTGGGCGT GGGGCCTGTC CTAAGTGAGG GTCTGCGGAG GCTTGCAGGT  2040

CCCCGGGATT CCCTGATCCA CGTGGCAGCT TACGCCGACC TGCGGTACCA CCAGGACGTG  2100

CTCATTGAGT GGCTGTGTGG AGAAGCCAAG CAGCCAGTCA ACCTCTGCAA ACCCAGCCCG  2160

TGCATGAATG AGGGCAGCTG CGTCCTGCAG AATGGGAGCT ACCGCTGCAA GTGTCGGGAT  2220
```

TABLE 20-continued

```
GGCTGGGAGG GCCCCCACTG CGAGAACCGT GAGTGGAGCT CTTGCTCTGT ATGTGTGAGC  2280

CAGGGATGGA TTCTTGAGAC GCCCCTGAGG CACATGGCTC CCGTGCAGGA GGGCAGCAGC  2340

CGTACCCCTC CCAGCAACTA CAGAGAAGGC CTGGGCACTG AAATGGTGCC TACCTTCTGG  2400

AATGTCTGTG CCCCAGGTCC TTAG
```

SEQ ID NO: 85 Protein sequence
Protein Accession #: Eos sequence

```
1          11         21         31         41         51
|          |          |          |          |          |
MPPFLLLEAV CVFLFSRVPP SLPLQEVHVS KETIGKISAA SKMMWCSAAV DIMFLLDGSN   60

SVGKGSFERS KHFAITVCDG LDISPERVRV GAFQPSSTPH LEFPLDSFST QQEVKARIKR  120

MVFKGGRTET ELALKYLLNR GLPGGRNASV PQILIIVTDG KSQGDVALPS KQLKERGVTV  180

FAVGVRFPRW EELHALASEP RGQHVLLAEQ VEDATNGLFS TLSSSAICSS ATPDCRVEAN  240

PCEHRTLEMV REFAGNAPCW RGSRRTLAVL AAHCPPYSWK RVFLTHPATC YRTTCPGPCD  300

SQPCQNGGTC VPEGLDGYQC LCPLAFGGEA NCALKLSLEC RVDLLFLLDS SAGTTLDGFL  360

RAKVFVKRFV RAVLSEDSRA RVGVATYSRE LLVAVPVGEY QDVPDLVWSL DGIPFRGGPT  420

LTGSALRQAA ERGFOSATET GQDRPRRVVV LLTESHSEDE VAGPARHARA RELLLLGVGS  480

EAVRAELEEI TGSPKHVNVY SDPQDLFNQI PELQGKLCSR QRPGCRTQAL DLVFMLDTSA  540

SVGPENFAQN QSFVRSCALQ FEVNPDVTQV GLVVYGSQVQ TAFGLDTKPT RAAMLRAISQ  600

APYLGGVGSA GTALLHIYDK VMTVQRGARP GVPKAVVVLT GGRGAEDAAV PAQKLRNNGI  660

SVLVVGVGPV LSEGLRRLAG PRDSLIHVAA YADLRYHQDV LIEWLCGEAK QPVNLCKPSP  720

CMNEGSCVLQ NGSYRCKCRD GWEGPNCENR EWSSCSVCVS QGWILETPLR HMAPVQEGSS  780

RTPPSNYREG LGTENVPTFW NVCAPGP
```

SEQ ID NO: 86 DNA sequence
Nucleic Acid Accession #: Eos sequence
Coding sequence: 89..2356

```
1          11         21         31         41         51
|          |          |          |          |          |
GCCCCCTGGC CCGAGCCGCG CCCGGGTCTG TGAGTAGAGC CGCCCGGGCA CCGAGCGCTG   60

GTCGCCGCTC TCCTTCCGTT ATATCAACAT GCCCCCTTTC CTGTTGCTGG AAGCCGTCTG  120

TGTTTTCCTG TTTTCCAGAG TGCCCCCATC TCTCCCTCTC CAGGAAGTCC ATGTAAGCAA  180

AGAAACCATC GGGAAGATTT CAGCTGCCAG CAAAATGATG TGGTGCTCGG CTGCAGTGGA  240

CATCATGTTT CTGTTAGATG GGTCTAACAG CGTCGGGAAA GGGAGCTTTG AAAGGTCCAA  300

GCACTTTGCC ATCACAGTCT GTGACGGTCT GGACATCAGC CCCGAGAGGG TCAGAGTGGG  360

AGCATTCCAG TTCAGTTCCA CTCCTCATCT GGAATTCCCC TTGGATTCAT TTTCAACCCA  420

ACAGGAAGTG AAGGCAAGAA TCAAGAGGAT GGTTTTCAAA GGAGGCGCA CGGAGACGGA  480

ACTTGCTCTG AAATACCTTC TGCACAGAGG GTTGCCTGGA GGCAGAAATG CTTCTGTGCC  540

CCAGATCCTC ATCATCGTCA CTGATGGGAA GTCCCAGGGG GATGTGGCAC TGCCATCCAA  600

GCAGCTGAAG GAAAGGGGTG TCACTGTGTT TGCTGTGGGG GTCAGGTTTC CAGGTGGGA  660

GGAGCTGCAT GCACTGGCCA GCGAGCCTAG AGGGCAGCAC GTGCTCTTGG CTGAGCAGGT  720

GGAGGATGCC ACCAACGGCC TCTTCAGCAC CCTCAGCAGC TCGGCCATCT GCTCCAGCGC  780

CACGCCAGAC TGCAGGGTCG AGGCTCACCC CTGTGAGCAC AGGACGCTGG AGATGGTCCG  840

GGAGTTCGCT GGCAATGCCC CATGCTGGAG AGGATCGCGG CGGACCCTTG CGGTGCTGGC  900

TGCACACTGT CCCTTCTACA GCTGGAAGAG AGTGTTCCTA ACCCACCCTG CCACCTGCTA  960

CAGGACCACC TGCCCAGGCC CCTGTGACTC GCAGCCCTGC CAGAATGGAG GCACATGTGT 1020
```

TABLE 20-continued

```
TCCAGAAGGA CTGGACGGCT ACCAGTGCCT CTGCCCGCTG GCCTTTGGAG GGGAGGCTAA 1080
CTGTGCCCTG AAGCTGAGCC TGGAATGCAG GGTCGACCTC CTCTTCCTGC TGGACAGCTC 1140
TGCGGGCACC ACTGTGGACG GCTTCCTGCG GGCCAAAGTC TTCGTGAAGC GGTTTGTGCG 1200
GGCCGTGCTG AGCGAGGACT CTCGGGCCCG AGTGGGTGTG GCCACATACA GCAGGGAGGT 1260
GCTGGTGGCG GTGCCTGTGG GGGAGTACCA GGATGTGCCT GACCTGGTCT GGAGCCTCGA 1320
TGGCATTCCC TTCCGTGGTG GCCCCACCCT GACGGGCAGT GCCTTGCGGC AGGCGGCAGA 1380
GCGTGGCTTC GGGAGCGCCA CCAGGACAGG CCAGGACCGG CCACGTAGAG TGGTGGTTTT 1440
GCTCACTGAG TCACACTCCG AGGATGAGGT TGCGGGCCCA GCGCGTCACG CAAGGGCGCG 1500
AGAGCTGCTC CTGCTGGGTG TAGGCAGTGA GGCCGTGCGG GCAGAGCTGG AGGAGATCAC 1560
AGGCAGCCCA AAGCATGTGA TGGTCTACTC GGATCCTCAG GATCTGTTCA ACCAAATCCC 1620
TGAGCTGCAG GGGAAGCTGT GCAGCCGGCA GCGGCCAGGG TGCCGGACAC AAGCCCTGGA 1680
CCTCGTCTTC ATGTTGGACA CCTCTGCCTC AGTAGGGCCC GAGAATTTTG CTCAGATGCA 1740
GAGCTTTGTG AGAAGCTGTG CCCTCCAGTT TGAGGTGAAC CCTGACGTGA CACAGGTCGG 1800
CCTGGTGGTG TATGGCAGCC AGGTGCAGAC TGCCTTCGGG CTGGACACCA AACCCACCCG 1860
GGCTGCGATG CTGCGGGCCA TTAGCCAGGC CCCCTACCTA GGTGGGGTGG GCTCAGCCGG 1920
CACCGCCCTG CTGCACATCT ATGACAAAGT GATGACCGTC CAGAGGGGTG CCCGGCCTGG 1980
TGTCCCCAAA GCTGTGGTGG TGCTCACAGG CGGGAGAGGC GCAGAGGATG CAGCCGTTCC 2040
TGCCCAGAAG CTGAGGAACA ATGGCATCTC TGTCTTGGTC GTGGGCGTGG GGCCTGTCCT 2100
AAGTGAGGGT CTGCGGAGGC TTGCAGGTCC CCGGGATTCC CTGATCCACG TGGCAGCTTA 2160
CGCCGACCTG CGGTACCACC AGGACGTGCT CATTGAGTGG CTGTGTGGAG AAGCCAAGCA 2220
GCCAGTCAAC CTCTGCAAAC CCAGCCCGTG CATGAATGAG GGCAGCTGCG TCCTGCAGAA 2280
TGGGAGCTAC CGCTGCAAGT GTCGGGATGG CTGGGAGGGC CCCCACTGCG AGAACCGATT 2340
CTTGAGACGC CCCTGAGGCA CATGGCTCCC GTGCAGGAGG GCAGCAGCCG TACCCCTCCC 2400
AGCAACTACA GAGAAGGCCT GGGCACTGAA ATGGTGCCTA CCTTCTGGAA TGTCTGTGCC 2460
CCAGGTCCTT AGAATGTCTG CTTCCCGCCG TGGCCAGGAC CACTATTCTC ACTGAGGGAG 2520
GAGGATGTCC CAACTGCAGC CATGCTGCTT AGAGACAAGA AAGCAGCTGA TGTCACCCAC 2580
AAACGATGTT GTTGAAAAGT TTTGATGTGT AAGTAAATAC CCACTTTCTG TACCTGCTGT 2640
GCCTTGTTGA GGCTATGTCA TCTGCCACCT TTCCCTTGAG GATAAACAAG GGGTCCTGAA 2700
GACTTAAATT TAGCGGCCTG ACGTTCCTTT GCACACAATC AATGCTCGCC AGAATGTTGT 2760
TGACACAGTA ATGCCCAGCA GAGGCCTTTA CTAGAGCATC CTTTGGACGG
```

```
SEQ ID NO: 87 Protein sequence
Protein Accession #: Eos sequence
1          11         21         31         41         51
|          |          |          |          |          |
MPPFLLLEAV CVFLFSRVPP SLPLQEVHVS KETIGKISAA SKMMNCSAAV DIMFLLDGSN  60
SVGKGSFERS KHFAITVCDG LDISPERVRV GAFQFSSTPH LEFPLDSFST QQEVKARIKR 120
MVFKGGRTET ELALKYLLHR GLPGGRNASV PQILIIVTDG KSQGDVALPS KQLKERGVTV 180
FAVGVRFPRW EELHALASEP RGQHVLLAEQ VEDATNGLFS TLSSSAICSS ATPDCRVEAH 240
PCEHRTLEMV REFAGNAPCW RGSRRTLAVL AAHCPFYSWK RVFLTHPATC YRTTCPGPCD 300
SQPCQNGGTC VPEGLDGYQC LCPLAFGGEA NCALKLSLEC RVDLLFLLDS SAGTTLDGFL 360
RAKVFVKRFV RAVLSEDSRA RVGVATYSRE LLVAVPVGEY QDVPDLVWSL DGIPFRGGPT 420
LTGSALRQAA ERGFGSATRT GQDRPRRVVV LLTESHSEDE VAGPARHARA RELLLLGVGS 480
```

TABLE 20-continued

```
EAVRAELEEI TGSPKHVMVY SDPQDLFNQI PELQGKLCSR QRPGCRTQAL DLVFMLDTSA    540

SVGPENFAQM QSFVRSCALQ FEVNPDVTQV GLVVYGSQVQ TAFGLDTKPT RAAMLRAISQ    600

APYLGGVGSA GTALLHIYDK VMTVQRGARP GVPKAVVVLT GGRGAEDAAV PAQKLRNNGI    660

SVLVVGVGPV LSEGLRRLAG PRDSLIHVAA YADLRYHQDV LIEWLCGEAK QPVNLCKPSP    720

CMNEGSCVLQ NGSYRCKCRD GWEGPHCENR FLRRP

SEQ ID NO: 88 DNA sequence
Nucleic Acid Accession #: NM_019894
Coding sequence: 1. .1314
1          11         21         31         41         51
|          |          |          |          |          |
ATGTTACAGG ATCCTGACAG TGATCAACCT CTGAACAGCC TCGATGTCAA ACCCCTGCGC     60

AAACCCCGTA TCCCCATGGA GACCTTCAGA AAGGTGGGGA TCCCCATCAT CATAGCACTA    120

CTGAGCCTGG CGAGTATCAT CATTGTGGTT GTCCTCATCA AGGTGATTCT GGATAAATAC    180

TACTTCCTCT GCGGGCAGCC TCTCCACTTC ATCCCGAGGA AGCAGCTGTG TGACGGAGAG    240

CTGGACTGTC CCTTGGGGGA GGACGAGGAG CACTGTGTCA AGAGCTTCCC CGAAGGGCCT    300

GCAGTGGCAG TCCGCCTCTC CAAGGACCGA TCCACACTGC AGGTGCTGGA CTCGGCCACA    360

GGGAACTGGT TCTCTGCCTG TTTCGACAAC TTCACAGAAG CTCTCGCTGA GACAGCCTGT    420

AGGCAGATGG GCTACAGCAG CAAACCCACT TTCAGAGCTG TGGAGATTGG CCCAGACCAG    480

GATCTGGATG TTGTTGAAAT CACAGAAAAC AGCCAGGAGC TTCGCATGCG GAACTCAAGT    540

GGGCCCTGTC TCTCAGGCTC CCTGGTCTCC CTGCACTGTC TTGCCTGTGG AAGAGCCTG     600

AAGACCCCC GTGTGGTGGG TGGGGAGGAG GCCTCTGTGG ATTCTTGGCC TTGGCAGGTC    660

AGCATCCAGT ACGACAAACA GCACGTCTGT GGAGGGAGCA TCCTGGACCC CCACTGGGTC    720

CTCACGGCAG CCCACTGCTT CAGGAAACAT ACCGATGTGT TCAACTGGAA GGTGCGGGCA    780

GGCTCAGACA AACTGGGCAC CTTCCCATCC CTGGCTGTGG CCAAGATCAT CATCATTGAA    840

TTCAACCCCA TGTACCCCAA AGACAATGAC ATCGCCCTCA TGAAGCTGCA GTTCCCACTC    900

ACTTTCTCAG GCACAGTCAG GCCCATCTGT CTGCCCTTCT TTGATGAGGA GCTCACTCCA    960

GCCACCCCAC TCTGGATCAT TGGATGGGGC TTTACGAAGC AGAATGGAGG GAAGATGTCT   1020

GACATACTGC TGCAGGCGTG AGTCCAGGTC ATTGACAGCA CACGGTGCAA TGCAGACGAT   1080

GCGTACCAGG GGGAAGTCAC CGAGAAGATG ATGTGTGCAG GCATCCCGGA AGGGGGTGTG   1140

GACACCTGCC AGGGTGACAG TGGTGGGCCC CTGATGTACC AATCTGACCA GTGGCATGTG   1200

GTGGGCATCG TTAGCTGGGG CTATGGCTGC GGGGGCCCGA GCACCCCAGG AGTATACACC   1260

AAGGTCTCAG CCTATCTCAA CTGGATCTAC AATGTCTGGA AGGCTGAGCT GTAA

SEQ ID NO: 89 Protein sequence
Protein Accession #: NP_063947.1
1          11         21         31         41         51
|          |          |          |          |          |
MLQDPDSDQP LNSLDVKPLR KPRIPMETFR KVGIPIIIAL LSLASIIIVV VLIKVILDKY     60

YFLCGQPLHF IPRKQLCDGE LDCPLGEDEE HCVKSFPEGP AVAVRLSKDR STLQVLDSAT   120

GNWFSACFDN FTEALAETAC RQMGYSSKPT FRAVEIGPDQ DLDVVEITEN SQELRMRNSS   180

GPCLSGSLVS LHCLACGKSL KTPRVVGGEE ASVDSWPWQV SIQYDKQHVC GGSILDPHWV   240

LTAAHCFRKH TDVFNWKVRA GSDKLGSFPS LAVAKIIIIE FNPMYPKDND IALMKLQFPL   300

TFSGTVRPIC LPFFDEELTP ATPLWIIGWG FTKQNGGKMS DILLQASVQV IDSTRCNADD   360

AYQGEVTEKM MCAGIPEGGV DTCQGDSGGP LMYQSDQWHV VGIVSWGYGC GGPSTPGVYT   420

KVSAYLNWIY NVWKAEL
```

TABLE 20-continued

```
SEQ ID NO: 90 DNA sequence
Nucleic Acid Accession #: NM_002776.1
Coding sequence: 82..912
1          11         21         31         41         51
|          |          |          |          |          |
ACCAGCGCCA GACCACAGGC AGGGCAGAGG CACGTCTGGG TCCCCTCCCT CCTTCCTATC   60

GGCGACTCCC AGATCCTGGC CATGAGAGCT CCGCACCTCC ACCTCTCCGC CGCCTCTCGC  120

GCCCGGGCTC TGGCGAAGCT GCTGCCGCTG CTGATGGCGC AACTCTGGGC CGCAGAGGCG  180

GCGCTGCTCC CCCAAAACGA CACGCGCTTG GACCCCGAAG CCTATGGCGC CCCGTGCGCG  240

CGCGGCTCGC AGCCCTGGCA GGTCTCGCTC TTCAACGGCC TCTCGTTCCA CTGCGCGGGT  300

GTCCTGGTGG ACCAGAGTTG GGTGCTGACG GCCGCGCACT GCGGAAACAA GCCACTGTGG  360

GCTCGAGTAG GGGATGATCA CCTGCTGCTT CTTCAGGGCG AGCAGCTCCG CCGGACGACT  420

CGCTCTGTTG TCCATCCCAA GTACCACCAG GGCTCAGGCC CCATCCTGCC AAGGCGAACG  480

GATGAGCACG ATCTCATGTT GCTAAAGCTG GCCAGGCCCG TAGTGCCGGG GCCCCGCGTC  540

CGGGCCCTGC AGCTTCCCTA CCGCTGTGCT CAGCCCGGAG ACCAGTGCCA GGTTGCTGGC  600

TGGGGCACCA CGGCCGCCCG GAGAGTGAAG TACAACAAGG GCCTGACCTG CTCCAGCATC  660

ACTATCCTGA GCCCTAAAGA GTGTGAGGTC TTCTACCCTG GCGTGGTCAC CAACAACATG  720

ATATGTGCTG GACTGGACCG GGGCCAGGAC CCTTGCCAGA GTGACTCTGG AGGCCCCCTG  780

GTCTGTGACG AGACCCTCCA AGGCATCCTC TCGTGGGGTG TTTACCCCTG TGGCTCTGCC  840

CAGCATCCAG CTGTCTACAC CCAGATCTGC AAATACATGT CCTGGATCAA TAAAGTCATA  900

CGCTCCAACT GATCCAGATG CTACGCTCCA GCTGATCCAG ATGTTATGCT CCTGCTGATC  960

CAGATGCCCA GAGGCTCCAT CGTCCATCCT CTTCCTCCCC AGTCGGCTGA ACTCTCCCCT 1020

TGTCTGCACT GTTCAAACCT CTGCCGCCCT CCACACCTCT AAACATCTCC CCTCTCACCT 1080

CATTCCCCCA CCTATCCCCA TTCTCTGCCT GTACTGAAGC TGAAATGCAG GAAGTGGTGG 1140

CAAAGGTTTA TTCCAGAGAA GCCAGGAAGC CGGTCATCAC CCAGCCTCTG AGAGCAGTTA 1200

CTGGGGTCAC CCAACCTGAC TTCCTCTGCC ACTCCCCGCT GTGTGACTTT GGGCAAGCCA 1260

AGTGCCCTCT CTGAACCTCA GTTTCCTCAT CTGCAAAATG GAACAATGA CGTGCCTACC 1320

TCTTAGACAT GTTGTGAGGA GACTATGATA TAACATGTGT ATGTAAATCT TCATGTGATT 1380

GTCATGTAAG GCTTAACACA GTGGGTGGTG AGTTCTGACT AAAGGTTACC TGTTGTCGTG 1440

AAAAAAAAAA AAAA

SEQ ID NO: 91 Protein sequence
Protein Accession #: NP_002767.1
1          11         21         31         41         51
|          |          |          |          |          |
MRAPHLHLSA ASGARALAKL LPLLMAQLWA AEAALLPQND TRLDPEAYGA PCARGSQPWQ   60

VSLFNGLSFH CAGVLVDQSW VLTAAHCGNK PLWARVGDDH LLLLQGEQLR RTTRSVVHPK  120

YHQGSGPILP RRTDEHDLML LKLARPVVPG PRVRALQLPY RCAQPGDQCQ VAGWGTTAAR  180

RVKYNKGLTC SSITILSPKE CEVFYPGVVT NNMICAGLDR GQDPCQSDSG GPLVCDETLQ  240

GILSWGVYPC GSAQHPAVYT QICKYMSWIN KVIRSN

SEQ ID NO: 92 DNA sequence
Nucleic Acid Accession #: NM_032044.1
Coding sequence: 182-658
1          11         21         31         41         51
|          |          |          |          |          |
AAGATATAAA AGCTCCAGAA ACGTTGACTG GGACCACTGG AGACACTGAA GAAGGCAGGG   60

GCCCTTAGAG TCTTGGTTGC CAAACAGATT TGCAGATCAA GGAGAACCCA GGAGTTTCAA  120

AGAAGCGCTA GTAAGGTCTC TGAGATCCTT GCACTAGCTA CATCCTCAGG GTAGGAGGAA  180
```

TABLE 20-continued

```
GATGGCTTCC AGAAGCATGC GGCTGCTCCT ATTGCTGAGC TGCCTGGCCA AAACAGGAGT  240

CCTGGGTGAT ATCATCATGA GACCCAGCTG TGCTCCTGGA TGGTTTTACC ACAAGTCCAA  300

TTGCTATGGT TACTTCAGGA AGCTGAGGAA CTGGTCTGAT GCCGAGCTCG AGTGTCAGTC  360

TTACGGAAAC GGAGCCCACC TGGCATCTAT CCTGAGTTTA AGGAAGCCA GCACCATAGC  420

AGAGTACATA AGTGGCTATC AGAGAAGCCA GCCGATATGG ATTGGCCTGC ACGACCCACA  480

GAAGAGGCAG CAGTGGCAGT GGATTGATGG GGCCATGTAT CTGTACAGAT CCTGGTCTGG  540

CAAGTCCATG GGTGGGAACA AGCACTGTGC TGAGATGAGC TCCAATAACA ACTTTTTAAC  600

TTGGAGCAGC AACGAATGCA ACAAGCGCCA ACACTTCCTG TGCAAGTACC GACCATAGAG  660

CAAGAATCAA GATTCTGCTA ACTCCTGCAC AGCCCCGTCC TCTTCCTTTC TGCTAGCCTG  720

GCTAAATCTG CTCATTATTT CAGAGGGGAA ACCTAGCAAA CTAAGAGTGA TAAGGGCCCT  780

ACTACACTGG CTTTTTTAGG CTTAGAGACA GAAACTTTAG CATTGGCCCA GTAGTGGCTT  840

CTAGCTCTAA ATGTTTGCCC CGCCATCCCT TTCCACAGTA TCCTTCTTCC CTCCTCCCCT  900

GTCTCTGGCT GTCTCGAGCA GTCTAGAAGA GTGCATCTCC AGCCTATGAA ACAGCTGGGT  960

CTTTGGCCAT AAGAAGTAAA GATTTGAAGA CAGAAGGAAG AAACTCAGGA GTAAGCTTCT 1020

AGACCCCTTC AGCTTCTACA CCCTTCTGCC CTCTCTCCAT TGCCTGCACC CCACCCCAGC 1080

CACTCAACTC CTGCTTGTTT TTCCTTTGGC CATAGGAAGG TTTACCAGTA GAATCCTTGC 1140

TAGGTTGATG TGGGCCATAC ATTCCTTTAA TAAACCATTG TGTACATAAG AAAAAAAAAA

SEQ ID NO: 93 Protein sequence
Protein Accession #: NP_114433.1
1          11         21         31         41         51
|          |          |          |          |          |
MASRSMRLLL LLSCLAKTGV LGDIIMRPSC APGWFYHKSN CYGYFRKLRN WSDAELECQS   60

YGNGAHLASI LSLKEASTIA EYISGYQRSQ PIWIGLHDPQ KRQQWQWIDG AMYLRSWSG  120

KSMGGNKHCA EMSSNNNFLT WSSNECNKRQ HFLCKYRP

SEQ ID NO. 94 DNA sequence
Nucleic Acid Accession #: XM_051860
Coding sequence. 1..4086
1          11         21         31         41         51
|          |          |          |          |          |
GAGCTAGCGC TCAAGCAGAG CCCAGCGCGG TGCTATCGGA CAGAGCCTGG CGAGCGCAAG   60

CGGCGCGGGG AGCCAGCGGG GCTGAGCGCG GCCAGGGTCT GAACCCAGAT TTCCCACACT  120

AGCTACCACT CCGCTTGCCC ACGCCCCGGG AGCTCGCGGC GCCTGGCGGT CAGCGACCAC  180

ACGTCCGGGG CCGCTGCGCT CCTGGCCCGC GAGGCGTGAC ACTGTCTCGG CTACAGACCC  240

AGAGGGAGCA CACTGCCAGG ATGGGAGCTG CTGGGAGGCA GGACTTCCTC TTCAACCCCA  300

TCCTGACCAT CAGCTGGCTC ACTCTGACCT GCTTCCCTGG GGCCACATCC ACAGTGGCTG  360

CTGGGTGCCC TGACCAGAGC CCTGAGTTGC AACCCTGGAA CCCTGGCCAT GACCAAGACC  420

ACCATGTGCA TATCGGCCAG GGCAAGACAC TGCTGCTCAC CTCTTCTGCC ACGGTCTATT  460

CCATCCACAT CTCAGAGGGA GGCAAGCTGG TCATTAAAGA CCACGACGAG CCGATTGTTT  540

TGCGAACCCG GCACATCCTG ATTGACAACG AGGAGAGCT GCATCCTGGG AGTGCCCTCT  600

GCCCTTTCCA GGGCAATTTC ACCATCATTT TGTATGAAG GGCTGATGAA GGTATTCAGC  660

CGGATCCTTA CTATGGTCTG AAGTACATTG GGGTTGGTAA AGGAGGCGCT CTTGAGTTGC  720

ATGGACAGAA AAAGCTCTCC TGGACATTTC TGAACAAGAC CCTTCACCCA GGTGGCATGG  780

CAGAAGGAGG CTATTTTTTT GAAAGGAGCT GGGGCCACCG TGGAGTTATT GTTCATGTCA  840

TCGACCCCAA ATCAGGCACA GTCATCCATT CTGACCGGTT TGACACCTAT AGATCCAAGA  900
```

TABLE 20-continued

```
AAGAGAGTGA ACGTCTGGTC CAGTATTTGA ACGCGGTGCC CGATGGCAGG ATCCTTTCTG  960
TTGCAGTGAA TGATGAAGGT TCTCGAAATC TGGATGACAT GGCCAGGAAG GCGATGACCA 1020
AATTGGGAAG CAAACACTTC CTGCACCTTG GATTTAGACA CCCTTGGAGT TTTCTAACTG 1080
TGAAAGGAAA TCCATCATCT TCAGTGGAAG ACCATATTGA ATATCATGGA CATCGAGGCT 1140
CTGCTGCTGC CCGGGTATTC AAATTGTTCC AGACAGAGCA TGGCGAATAT TTCAATGTTT 1200
CTTTGTCCAG TGAGTGGGTT CAAGACGTGG AGTGGACGGA GTGGTTCGAT CATGATAAAG 1260
TATCTCAGAC TAAAGGTGGG GAGAAAATTT CAGACCTCTG GAAAGCTCAC CCAGGAAAAA 1320
TATGCAATCG TCCCATTGAT ATACAGGCCA CTACAATGGA TGGAGTTAAC CTCAGCACCG 1380
AGGTTGTCTA CAAAAAAGGC CAGGATTATA GGTTTGCTTG CTACGACCGG GGCAGAGCCT 1440
GCCGGAGCTA CCGTGTACGG TTCCTCTGTG GAAGCCTGT GAGGCCCAAA CTCACAGTCA 1500
CCATTGACAC CAATGTGAAC AGCACCATTC TGAACTTGGA GGATAATGTA CAGTCATGGA 1560
AACCTGGAGA TACCCTGGTC ATTGCCAGTA CTGATTACTC CATGTACCAG GCAGAAGAGT 1620
TCCAGGTGCT TCCCTGCAGA TCCTGCGCCC CAACCAGGT CAAAGTGGCA GGGAAACCAA 1680
TGTACCTGCA CATCGGGGAG GAGATAGACG GCGTGGACAT GCGGGCGGAG GTTGGGCTTC 1740
TGAGCCGGAA CATCATAGTG ATGGGGGAGA TGGAGGACAA ATGCTACCCC TACAGAAACC 1800
ACATCTGCAA TTTCTTTGAC TTCGATACCT TTGGGGGCCA CATCAAGTTT GCTCTGGGAT 1860
TTAAGGCAGC ACACTTGGAG GGCACGGAGC TGAAGCATAT GGGACACCAG CTGGTGGGTC 1920
AGTACCCGAT TCACTTCCAC CTGGCCGGTG ATGTAGACGA AAGGGGAGGT TATGACCCAC 1980
CCACATACAT CAGGGACCTC TCCATCCATC ATACATTCTC TCGCTGCGTC ACAGTCCATG 2040
GCTCCAATGG CTTGTTGATC AAGGACGTTG TGGGCTATAA CTCTTTGGGC CACTGCTTCT 2100
TCACGGAAGA TGGGCCGGAG GAACGCAACA CTTTTGACCA CTGTCTTGGC CTCCTTGTCA 2160
AGTCTGGAAC CCTCCTCCCC TCGGACCGTG ACAGCAAGAT GTGCAAGATG ATCACAGAGG 2220
ACTCCTACCC GGGGTACATC CCCAAGCCCA GGCAAGACTG CAATGCTGTG TCCACCTTCT 2280
GGATGGCCAA TCCAACAAC AACCTCATCA ACTGTGCCGC TGCAGGATCT GAGGAAACTG 2340
GATTTTGGTT TATTTTTCAC CACGTACCAA CGGGCCCCTC CGTGGGAATG TACTCCCCAG 2400
GTTATTCAGA GCACATTCCA CTGGGAAAAT TCTATAACAA CCGAGCACAT TCCAACTACC 2460
GGGCTGGCAT GATCATAGAC AACGGAGTCA AAACCACCGA GGCCTCTGCC AAGGACAAGC 2520
GGCCGTTCCT CTCAATCATC TCTGCCAGAT ACAGCCCTCA CCAGGACGCC GACCCGCTGA 2580
AGCCCCGGGA GCCGGCCATC ATCAGACACT TCATTGCCTA CAAGAACCAG GACCACGGGG 2640
CCTGGCTGCG CGGCGGGGAT GTGTGGCTGG ACAGCTGCCG GTTTGCTGAC AATGGCATTG 2700
GCCTGACCCT GGCCAGTGGT GGAACCTTCC CGTATGACGA CGGCTCCAAG CAAGAGATAA 2760
AGAACAGCTT GTTTGTTGGC GAGAGTGGCA ACGTGGGGAC GGAAATGATG GACAATAGGA 2820
TCTGGGGCCC TGGCGGCTTG GACCATAGCG GAAGGACCCT CCCTATAGGC CAGAATTTTC 2880
CAATTAGAGG AATTCAGTTA TATGATGGCC CCATCAACAT CCAAAACTGC ACTTTCCGAA 2940
AGTTTGTGGC CCTGGAGGGC CGGCACACCA GCGCCCTGGC CTTCCGCCTG AATAATGCCT 3000
GGCAGAGCTG CCCCCATAAC AACGTGACCG GCATTGCCTT TGAGGACGTT CCGATTACTT 3060
CCAGAGTGTT CTTCGGAGAG CCTGGGCCCT GGTTCAACCA GCTGGACATG GATGGGGATA 3120
AGACATCTGT GTTCCATGAC GTCGACGGCT CCGTGTCCGA GTACCCTGGC TCCTACCTCA 3180
CGAAGAATGA CAACTGGCTG GTCCGGCACC CAGACTGCAT CAATGTTCCC GACTGGAGAG 3240
GGGCCATTTG CAGTGGGTGC TATGCACAGA TGTACATTCA AGCCTACAAG ACCAGTAACC 3300
```

TABLE 20-continued

```
TGCGAATGAA GATCATCAAG AATGACTTCC CCAGCCACCC TCTTTACCTG GAGGGGCGC  3360
TCACCAGGAG CACCCATTAC CAGCAATACC AACCGGTTGT CACCCTGCAG AAGGGCTACA  3420
CCATCCACTG GGACCAGACG GCCCCCGCCG AACTCGCCAT CTGGCTCATC AACTTCAACA  3480
AGGGCGACTG GATCCGAGTG GGCCTCTGCT ACCCGCGAGG CACCACATTC TCCATCCTCT  3540
CGGATGTTCA CAATCGCCTG CTGAAGCAAA CGTCCAAGAC GGGCGTCTTC GTGAGGACCT  3600
TGCAGATGGA CAAAGTGGAC CAGAGCTACC CTGGCAGGAG CCACTACTAC TGGGACGAGG  3660
ACTCAGGGCT GTTGTTCCTG AAGCTGAAAG CTCAGAACGA GAGAGAGAAG TTTGCTTTCT  3720
GCTCCATGAA AGGCTGTGAC AGGATAAAGA TTAAAGCTCT GATTCCAAAG AACGCAGGCG  3780
TCAGTGACTG CACAGCCACA GCTTACCCCA AGTTCACCGA GAGGGCTGTC GTAGACGTGC  3840
CGATGCCCAA GAAGCTCTTT GGTTCTCAGC TGAAAACAAA GGACCATTTC TTGGAGGTGA  3900
AGATGGAGAG TTCCAAGCAG CACTTCTTCC ACCTCTGGAA CGACTTCGCT TACATTGAAG  3960
TGGATGGGAA GAAGTACCCC AGTTCGGAGG ATGGCATCCA GGTGGTGGTG ATTGACGGGA  4020
ACCAAGGGCG CGTGGTGAGC CACACGAGCT TCAGGAACTC CATTCTGCAA GGCATACCAT  4080
GGCAGCTTTT CAACTATGTG GCGACCATCC CTGACAATTC CATACTGCTT ATGGCATCAA  4140
AGGGAAGATA CGTCTCCACA GGCCCATGGA CCAGAGTGCT GGAAAAGCTT GGGGCAGACA  4200
GGGGTCTCAA GTTGAAAGAC CAAATGGCAT TCGTTGGCTT CAAAGGCAGC TTCCGGCCCA  4260
TCTGGGTGAC ACTGCACACT GAGGATCACA AAGCCAAAAT CTTCCAAGTT GTGCCCATCC  4320
CTGTGGTGAA GAAGAAGAAG TTGTGAGGAC AGCTGCCGCC CGGTGCCACC TCGTCCTAGA  4380
CTATGACGGT GACTCTTGGC AGCAGACCAG TGGGGGATGG CTGGGTCCCC CAGCCCCTGC  4440
CAGCAGCTGC CTGGGAAGGC CGTGTTTCAG CCCTGATGGG CCAAGGGAAG CTATCAGAG  4500
ACCCTGGTGC TCCCACCTGC CCCTACTCAA GTGTCTACCT GGAGCCCCTG GGGCGGTGCT  4560
GGCCAATGCT GGAAACATTC ACTTTCCTGC AGCCTCTTGG GTGCTTCTCT CCTATCTGTG  4620
CCTCTTCAGT GGGGGTTTGG GGACCATATC AGGAGACCTG GGTTGTGCTG ACAGCAAAGA  4680
TCCACTTTGG CAGGAGCCCT GACCCAGCTA GGAGGTAGTC TGGAGGGCTG GTCATTCACA  4740
GATCCCCATG GTCTTCAGCA GACAAGTGAG GGTGGTAAAT GTAGGAGAAA GAGCCTTGGC  4800
CTTAAGGAAA TCTTTACTCC TGTAAGCAAG AGCCAACCTC ACAGGATTAG GAGCTGGGGT  4860
AGAACTGGCT ATCCTTGGGG AAGAGGCAAG CCCTGCCTCT GGCCGTGTCC ACCTTTCAGG  4920
AGACTTTGAG TGGCAGGTTT GGACTTGGAC TAGATGACTC TCAAAGGCCC TTTTAGTTCT  4980
GAGATTCCAG AAATCTGCTG CATTTCACAT GGTACCTGGA ACCAACAGT TCATGGATAT  5040
CCACTGATAT CCATGATGCT GGGTGCCCCA GCGCACACGG GATGGAGAGG TGAGAACTAA  5100
TGCCTAGCTT GAGGGGTCTG CAGTCCAGTA GGGCAGGCAG TCAGGTCCAT GTGCACTGCA  5160
ATGCCAGGTG GAGAAATCAC AGAGAGGTAA AATGGAGGCC AGTGCCATTT CAGAGGGGAG  5220
GCTCAGGAAG GCTTCTTGCT TACAGGAATG AAGGCTGGGG GCATTTTGCT GGGGGGAGAT  5280
GAGGCAGCCT CTGGAATGGC TCAGGGATTC AGCCCTCCCT GCCGCTGCCT GCTGAAGCTG  5340
GTGACTACGG GGTCGCCCTT TGCTCACGTC TCTCTGGCCC ACTCATGATG GAGAAGTGTG  5400
GTCAGAGGGG AGCAATGGGC TTTGCTGCTT ATGAGCACAG AGGAATTCAG TCCCCAGGCA  5460
GCCCTGCCTC TGACTCCAAG AGGGTGAAGT CCACAGAAGT GAGCTCCTGC CTTAGGGCCT  5520
CATTTGCTCT TCATCCAGGG AACTGAGCAC AGGGGGCCTC CAGGAGACCC TAGATGTGCT  5580
CGTACTCCCT CGGCCTGGGA TTTCAGAGCT GGAAATATAG AAAATATCTA GCCCAAAGCC  5640
TTCATTTTAA CAGATGGGGA AAGTGAGCCC CCAAGATGGG AAAGAACCAC ACAGCTAAGG  5700
```

TABLE 20-continued

```
GAGGGCCTGG GGAGCCCCAC CCTAGCCCTT GCTGCCACAC CACATTGCCT CAACAACCGG 5760
CCCCAGAGTG CCCAGGCACT CCTGAGGTAG CTTCTGGAAA TGGGGACAAG TCCCCTCGAA 5820
GGAAAGGAAA TGACTAGACT AGAATGACAG CTAGCAGATC TCTTCCCTCC TGCTCCCAGC 5880
GCACACAAAC CCGCCCTCCC CTTGGTGTTG GCGGTCCCTG TGGCCTTCAC TTTGTTCACT 5940
ACCTGTCAGC CCAGCCTGGG TGCACAGTAG CTGCAACTCC CCATTGGTGC TACCTGGCTC 6000
TCCTGTCTCT GCAGCTCTAC AGGTGAGGCC CAGCAGAGGG AGTAGGGCTC GCCATGTTTC 6060
TGGTGAGCCA ATTTGGCTGA TCTTGGGTGT CTGAACAGCT ATTGGGTCCA CCCCAGTCCC 6120
TTTCAGCTGC TGCTTAATGC CCTGCTCTCT CCCTGGCCCA CCTTATAGAG AGCCCAAAGA 6180
GCTCCTGTAA GAGGGAGAAC TCTATCTGTG GTTTATAATC TTGCACGAGG CACCAGAGTC 6240
TCCCTGGGTC TTGTGATGAA CTACATTTAT CCCCTTTCCT GCCCCAACCA CAAACTCTTT 6300
CCTTCAAAGA GGGCCTGCCT GGCTCCCTCC ACCCAACTGC ACCCATGAGA CTCGGTCCAA 6360
GAGTCCATTC CCCAGGTGGG AGCCAACTGT CAGGGAGGTC TTTCCCACCA ACATCTTTC 6420
AGCTGCTGGG AGGTGACCAT AGGGCTCTGC TTTTAAAGAT ATGGCTGCTT CAAAGGCCAG 6480
AGTCACAGGA AGGACTTCTT CCAGGGAGAT TAGTGGTGAT GGAGAGGAGA GTTAAAATGA 6540
CCTCATGTCC TTCTTGTCCA CGGTTTTGTT GAGTTTTCAC TCTTCTAATG CAAGGGTCTC 6600
ACACTGTGAA CCACTTAGGA TGTGATCACT TTCAGGTGGC CAGGAATGTT GAATGTCTTT 6660
GGCTCAGTTC ATTTAAAAAA GATATCTATT TGAAAGTTCT CAGAGTTGTA CATATGTTTC 6720
ACAGTACAGG ATCTGTACAT AAAAGTTTCT TTCCTAAACC ATTCACCAAG AGCCAATATC 6780
TAGGCATTTT CTTGGTAGCA CAAATTTTCT TATTGCTTAG AAAATTGTCC TCCTTGTTAT 6840
TTCTGTTTGT AAGACTTAAG TGAGTTAGGT CTTTAAGGAA AGCAACGCTC CTCTGAAATG 6900
CTTGTCTTTT TTCTGTTGCC GAAATAGCTG GTCCTTTTTC GGGAGTTAGA TGTATAGAGT 6960
GTTTGTATGT AAACATTTCT TGTAGGCATC ACCATGAACA AAGATATATT TTCTATTTAT 7020
TTATTATATG TGCACTTCAA GAAGTCACTG TCAGAGAAAT AAAGAATTGT CTTAAATGTC
```

SEQ ID NO: 95 Protein sequence
Protein Accession #: XP_051860.2

```
1          11         21         31         41         51
|          |          |          |          |          |
MGAAGRQDFL FKAMLTISWL TLTCFPGATS TVAAGCPDQS PELQPWNPGH DQDHHVHIGQ  60
GKTLLLTSSA TVYSIHISEG GKLVIKDHDE PIVLRTRHIL IDNGGELHAG SALCPFQGNF 120
TIILYGRADE GIQPDPYYGL KYIGVGKGGA LELHGQKKLS WTFLNKTLHP GGMAEGGYFF 180
ERSWGHRGVI VHVIDPKSGT VIHSDRFDTY RSKKESERLV QYLNAVPDGR ILSVAVNDEG 240
SRNLDDMARK AMTKLGSKHF LHLGFRHPWS FLTVKGNPSS SVEDHIEYHG HRGSAAARVF 300
KLFQTEHGEY FNVSLSSEWV QGVEWTEWFD HDKVSQTKGG EKISDLWKAH PGKICNRPID 360
IQATTMDGVN LSTEVVYKKG QDYRFACYDR GRACRSYRVR FLCGKPVRPK LTVTIDTNVN 420
STILNLEDNV QSWKPGDTLV IASTDYSMYQ AEEFQVLPCR SCAPNQVKVA GKPMYLHIGE 480
EIDGVDMRAE VGLLSRNIIV MGEMEDKCYP YRNHICNFFD FDTFGGHIKF ALGFKAAHLE 540
GTELKHMGQQ LVGQYPIHFH LAGDVDERGG YDPPTYIRDL SIHHTFSRCV TVHGSNGLLI 600
KDVVGYNSLG HCFFTEDGPE ERNTPDHCLG LLVKSGTLLP SDRDSKMCKM ITEDSYPGYI 660
PKPRQDCNAV STFWMANPNN NLINCAAAGS EETGFWFIFH HVPTGPSVGM YSPGYSEHIP 720
LGKFYNNRAH SNYRAGMIID NGVKTTEASA KDKRPFLSII SARYSPHQDA DPLKPREPAI 780
IRHFIAYKNQ DHGAWLRGGD VWLDSCRFAD NGIGLTLASG GTFPYDDGSK QEIKNSLFVG 840
ESGNVGTEMM DNRIWGPGGL DHSGRTLPIG QNFPIRGIQL YDGPINIQNC TFRKFVALEG 900
```

TABLE 20-continued

```
RHTSALAFRL NNAWQSCPHN NVTGIAFEDV PITSRVFFGE PGPWFNQLDM DGDKTSVFHD  860

VDGSVSEYPG SYLTKNDNWL VRHPDCINVP DWRGAICSGC YAQMYIQAYK TSNLRMKIIK 1020

NDFPSHPLYL EGALTRSTHY QQYQPVVTLQ KGYTIHWDQT APAELAIWLI NFNKGDWIRV 1080

GLCYPRGTTF SILSDVHNRL LKQTSKTGVF VRTLQMDKVE QSYPGRSHYY WDEDSGLLFL 1140

KLKAQNEREK FAFCSMKGCE RIKIKALIPK NAGVSDCTAT AYPKFTERAV VDVPMPKKLF 1200

GSQLKTKDHF LEVKMESSKQ HFFHLWNDFA YIEVDGKKYP SSEDGIQVVV IDGNQGRVVS 1260

HTSFRNSILQ GIPWQLFNYV ATIPDNSIVL MASKGRYVSR GPWTRVLEKL GADRGLKLKE 1320

QMAFVGFKGS FRPIWVTLDT EDHKAKIFQV VPIPVVKKKK L

SEQ ID NO: 96 DNA sequence
Nucleic Acid Accession #: NM_020436 and AK001666
Coding sequence: 63-3224
  1          11         21         31         41         51
  |          |          |          |          |          |
CAGGAATTTG TGGCGGAGAG GGCAAATAAC TGCGGCTCTC CCGGCGCCCC GATGCTCGCA   60

CCATGTCGAG GCGCAAGCAG GCGAAACCCC AGCACATCAA CTCGGAGGAG GACCAGGGCG  120

AGCAGCAGCC GCAGCAGCAG ACCCCGGAGT TTGCAGATGC GGCCCCAGCG GCGCCCGCGG  180

CGGGGGAGCT GGGTGCTCCA GTGAACCACC CAGGGAATGA CGAGGTGGCG AGTGAGGATG  240

AAGCCACAGT AAAGCGGCTT CGTCGGGAGG AGACGCACGT CTGTGAGAAA TGCTGTGCGG  300

AGTTCTTCAG CATCTCTGAG TTCCTGGAAC ATAAGAAAAA TTGCACTAAA AATCCACCTG  360

TCCTCATCAT GAATGACAGC GAGGGGCCTG TGCCTTCAGA AGACTTCTCC GGAGCTGTAC  420

TGAGCCACCA GCCCACCAGT CCCGGCAGTA AGGACTGTCA CAGGGAGAAT GGCGGCAGCT  480

CAGAGGACAT GAAGGAGAAG CCGGATGCGG AGTCTGTGGT GTACCTAAAG ACAGAGACAG  540

CCCTGCCACC CACCCCCCAG GACATAAGCT ATTTAGCCAA AGGCAAAGTG GCCAACACTA  600

ATGTGACCTT GCAGGCACTA CGGGGCACCA AGGTGGCGGT GAATCAGCGG AGCGCGGATG  660

CACTCCCTGC CCCCGTGCCT GGTGCCAACA GCATCCCGTG GGTCCTCGAG CAGATCTTGT  720

GTCTGCAGCA GCAGCAGCTA CAGCAGATCC AGCTCACCGA GCAGATCCGC ATCCAGGTGA  780

ACATGTGGGC CTCCCACGCC CTCCACTCAA GCGGGGCAGG GGCCGACACT CTGAAGACCT  840

TGGGCAGCCA CATGTCTCAG CAGGTTTCTG CAGCTGTGGC TTTGCTCAGC CAGAAAGCTG  900

GAAGCCAAGG TCTGTCTCTG GATGCCTTGA ACAAGCCAA GCTACCTCAC GCCAACATCC  960

CTTCTGCCAC CAGCTCCCTG TCCCCAGGGC TGGCACCCTT CACTCTGAAG CCGGATGGGA 1020

CCCGGGTGCT CCCGAACGTC ATGTCCCGCC TCCCGAGCGC TTTGCTTCCT CAGGCCCCGG 1080

GCTCGGTGCT CTTCCAGAGC CCTTTCTCCA CTGTGGCGCT AGACACATCC AAGAAAGGGA 1140

AGGGGAAGCC ACCGAACATC TCCGCGGTGG ATGTCAAACC CAAAGACGAG GCGGCCCTCT 1200

ACAAGCACAA GTGTAAGTAC TGTAGCAAGG TTTTTGGGAC TGATAGCTCC TTGCAGATCC 1260

ACCTCCGCTC CCACACTGGA GAGAGACCCT TCGTGTGCTC TGTCTGTGGT CATCGCTTCA 1320

CCACCAAGGG CAACCTCAAG GTGCACTTTC ACCGACATCC CCAGGTGAAG GCAAACCCCC 1380

AGCTGTTTGC CGAGTTCCAG GACAAAGTGG CGGCCGGCAA TGGCATCCCC TATGCACTCT 1440

CTGTACCTGA CCCCATAGAT GAACCGAGTC TTTCTTTAGA CAGCAAACCT GTCCTTGTAA 1500

CCACCTCTGT AGGGCTACCT CAGAATCTTT CTTCGGGGAC TAATCCCAAG GACCTCACGG 1560

GTGGCTCCTT GCCCGGTGAC CTGCAGCCTG GGCCTTCTCC AGAAAGTGAG GGTGGACCCA 1620

CACTCCCTGG GGTGGGACCA AACTATAATT CCCCAAGGGC TGGTGGCTTC CAAGGGAGTG 1680

GGACCCCTGA GCCAGGGTCA GAGACCCTGA AATTGCAGCA GTTGGTGGAG AACATTGACA 1740
```

TABLE 20-continued

```
AGGCCACCAC TGATCCCAAC GAATGTCTCA TTTGCCACCG AGTCTTAAGC TGTCAGAGCT 1800

CCCTCAAGAT GCATTATCGC ACCCACACCG GGGAGAGACC GTTCCAGTGT AAGATCTGTG 1860

GCCGAGCCTT TTCTACCAAA GGTAACCTGA AGACACACCT TGGGGTTCAC CGAACCAACA 1920

CATCCATTAA GACGCAGCAT TCGTGCCCCA TCTGCCAGAA GAAGTTCACT AATGCCGTGA 1980

TGCTGCAGCA ACATATTCGG ATGCACATGG GCGGTCAGAT TCCCAACACG CCCCTGCCAG 2040

AGAATCCCTG TGACTTTACG GGTTCTGAGC CAATGACCGT GGGTGAGAAC GGCAGCACCG 2100

GCGCTATCTG CCATGATGAT GTCATCGAAA GCATCGATGT AGAGGAAGTC AGCTCCCAGG 2160

AGGCTCCCAG CAGCTCCTCC AAGGTCCCCA CGCCTCTTCC CAGCATCCAC TCGGCATCAC 2220

CCACGCTAGG GTTTGCCATG ATGGCTTCCT TAGATGCCCC AGGGAAAGTG GGTCCTGCCC 2200

CTTTTAACCT GCAGCGCCAG GGCAGCAGAG AAAACGGTTC CGTGGAGAGC GATGGCTTGA 2340

CCAACGACTC ATCCTCGCTG ATGGGAGACC AGGAGTATCA GAGCCGAAGC CCAGATATCC 2400

TGGAAACCAC ATCCTTCCAG GCACTCTCCC CGGCCAATAG TCAAGCCGAA AGCATCAAGT 2460

CAAAGTCTCC CGATGCTGGG AGCAAAGCAG AGAGCTCCGA GAACAGCCGC ACTGAGATGG 2520

AAGGTCGGAG CAGTCTCCCT TCCACGTTTA TCCGAGCCCC GCCGACCTAT GTCAAGGTTG 2580

AAGTTCCTGG CACATTTGTG GGACCCTCGA CATTGTCCCC AGGGATGACC CCTTTGTTAG 2640

CAGCCCAGCC ACGCCGACAG GCCAAGCAAC ATGGCTGCAC ACGGTGTGGG AAGAACTTCT 2700

CGTCTGCTAG CGCTCTTCAG ATCCACGAGC GGACTCACAC TGGAGAGAAG CCTTTTGTGT 2760

GCAACATTTG TGGGCGAGCT TTTACCACCA AAGGCAACTT AAAGGTTCAC TACATGACAC 2820

ACGGGGCGAA CAATAACTCA GCCCGCCGTG GAAGGAAGTT GGCCATCGAG AACACCATGG 2880

CTCTGTTAGG TACGGACGGA AAAAGAGTCT CAGAAATCTT TCCCAAGGAA ATCCTGGCCC 2940

CTTCAGTGAA TGTGGACCCT GTTGTGTGGA ACCAGTACAC CAGCATGCTC AATGGCGGTC 3000

TGGCCGTGAA GACCAATGAG ATCTCTGTGA TCCAGAGTGG GGGGGTTCCT ACCCTCCCGG 3060

TTTCCTTGGG GGCCACCTCC GTTGTGAATA ACGCCACTGT CTCCAAGATG GATGGCTCCC 3120

AGTCGGGTAT CAGTGCAGAT GTGGAAAAAC CAAGTGCTAC TGACGGCGTT CCCAAACACC 3180

AGTTTCCTCA CTTCCTGGAA GAAAACAAGA TTGCGGTCAG CTAAGGGAGA ACTTGCGTGG 3240

AAGGAGCAAT GCAGACACAG TGAAATCTCT AGAATCTGCT TTGTTTTGTA AGAACTCATC 3300

TCCTCCTGTT TTCTTTTTCT TACTGATATG CAAATGATGT TTACTACGTT GGTTGTGACC 3360

ACAACCTCAG GCAAGTGCTA CAATCACGAT TGTTGCTATG CTGCTTTGCA AAAAGTTG
```

SEQ ID NO: 97 protein sequence
Protein Accession #: NP_065169.1

```
1          11         21         31         41         51
|          |          |          |          |          |
MSRRKQAKPQ HINSEEDQGE QQPQQQTPEF ADAAPAAPAA GELGAPVNHP GNDEVASEDE  60

ATVKRLRREE THVCEKCCAE FFSISEFLEH KKNCTKNPPV LIMNDSEGPV PSEDFSGAVL 120

SHQPTSPGSK DCHRENGGSS EDMKEKPDAE SVVYLKTETA LPPTPQDISY LAKGKVANTN 190

VTLQALRGTK VAVNQRSADA LPAPVPGANS IPWVLEQILC LQQQQLQQIQ LTEQIRIQVN 240

MWASHALHSS GAGADTLKTL GSHMSQQVSA AVALLSQKAG SQGLSLDALK QAKLPHANIP 300

SATSSLSPGL APFTLKPDGT RVLPNVMSRL PSALLPQAPG SVLFQSPFST VALDTSKKGK 360

GKPPNISAVD VKPKDEAALY KHKCKYCSKV FGTDSSLQIH LRSHTGERPF VCSVCGHRFT 420

TKGNLKVNFH RHPQVKANPQ LFAEFQDKVA AGNGIPYALS VPDPIDEPSL SLDSKPVLVT 480

TSVGLPQNLS SGTNPKDLTG GSLPGDLQPG PSPESEGGPT LPGVGPNYNS PRAGGFQGSG 540

TPEPGSETLK LQQLVENIDK ATTDPNECLI CNRVLSCQSS LKMHYRTHTG ERPFQCKICG 600
```

TABLE 20-continued

```
RAFSTKGNLK THLGVHRTNT SIKTQHSCPI CQKKFTNAVM LQQHIRMHMG GQIPNTPLPE  660

NPCDFTGSEP MTVGENGSTG AICHDDVIES IDVEEVSSQE APSSSSKVPT PLPSHISASP  720

TLGFAMMASL DAPGKVGPAP FNLQRQGSRE NGSVESDGLT NDSSSLMGDQ EYQSRSPDIL  780

ETTSFQALSP ANSQAESIKS KSPDAGSKAE SSENSRTEME GRSSLPSTFI RAPPTYVKVE  840

VPGTFVGPST LSPGMTPLLA AQPRRQAKQH GCTRCGKNFS SASALQIHER THTGEKPFVC  900

NICGRAFTTK GNLKVHYMTH GANNNSARRG RKLAIENTMA LLGTDGKRVS EIFPKEILAP  960

SVNVDPVVWN QYTSMLNGGL AVKTNEISVI QSGGVPTLPV SLGATSVVNN ATVSKMDGSQ 1020

SGISADVEKP SATDGVPKHQ FPHFLEENKI AVS

SEQ ID NO: 98 DNA sequence
Nucleic Acid Accession #: NM_000612.2
Coding sequence 553. .1095
1          11         21         31         41         51
|          |          |          |          |          |
TTCTCCCGCA ACCTTCCCTT CGCTCCCTCC CGTCCCCCCC AGCTCCTAGC CTCCGACTCC  60

CTCCCCCCCT CACGCCCGCC CTCTCGCCTT CGCCGAACCA AAGTGGATTA ATTACACGCT 120

TTCTGTTTCT CTCCGTGCTG TTCTCTCCCG CTGTGCGCCT GCCCGCCTCT CGCTGTCCTC 180

TCTCCCCCTC GCCCTCTCTT CGGCCCCCCC CTTTCACGTT CACTCTGTCT CTCCCACTAT 240

CTCTGCCCCC CTCTATCCTT GATACAACAG CTGACCTCAT TTCCCGATAC CTTTTCCCCC 300

CCGAAAAGTA CAACATCTGG CCCGCCCCAG CCCGAAGACA GCCCGTCCTC CCTGGACAAT 360

CAGACGAATT CTCCCCCCCC CCCCAAAAAA AAAAGCCATC CCCCCGCTCT GCCCCGTCGC 420

ACATTCGGCC CCCGCGACTC GGCCAGAGCG GCGCTGGCAG AGGAGTGTCC GGCAGGAGGG 480

CCAACGCCCG CTGTTCGGTT TGCGACACGC ACCAGGGAGG TGGGCGGCAG CGTCGCCGGC 540

TTCCAGACAC CAATGGGAAT CCCAATGGGG AAGTCGATGC TGGTGCTTCT CACCTTCTTG 600

GCCTTCGCCT CGTGCTGCAT TGCTGCTTAC CGCCCCAGTG AGACCCTGTG CGGCGGGGAG 660

CTGGTGGACA CCCTCCAGTT CGTCTGTGGG GACCGCGGCT TCTACTTCAG CAGGCCCGCA 720

AGCCGTGTGA GCCGTCGCAG CCGTGGCATC GTTGAGGAGT GCTGTTTCCG CAGCTGTGAC 780

CTGGCCCTCC TGGAGACGTA CTGTGCTACC CCGCCAAGT CCGAGAGGGA CGTGTCGACC 840

CCTCCGACCG TGCTTCCGGA CAACTTCCCC AGATACCCCG TGGGCAAGTT CTTCCAATAT 900

GACACCTGGA AGCAGTCCAC CCAGCGCCTG CGCAGGGGCC TGCCTGCCCT CCTGCGTGCC 960

CGCCGGGGTC ACGTGCTCGC CAAGGAGCTC GAGGCGTTCA GGGAGGCCAA ACGTCACCGT 1020

CCCCTGATTG CTCTACCCAC CCAAGACCCC GCCCACGGGG GCGCCCCCCC AGAGATGGCC 1080

AGCAATCGGA AGTGAGCAAA ACTGCCGCAA GTCTGCAGCC GGGCGCCACC ATCCTGCAGC 1140

CTCCTCCTGA CCACGGACGT TCCATCAGG TTCCATCCCG AAAATCTCTC GGTTCCACGT 1200

CCCCCTGGGG CTTCTCCTGA CCCAGTCCCC GTGCCCCGCC TCCCCGAAAC AGGCTACTCT 1260

CCTCGGCCCC CTCCATCGGG CTGAGGAAGC ACAGCAGCAT CTTCAAACAT GTACAAAATC 1320

GATTGGCTTT AAACACCCTT CACATACCCT CCCCCC

SEQ ID NO: 99 Protein sequence
Protein Accession #: NP_000603.1
1          11         21         31         41         51
|          |          |          |          |          |
MGIPMGKSML VLLTFLAFAS CCIAAYRPSE TLCGGELVDT LQFVCGDRGF YFSRPASRVS  60

RRSRGIVEEC CFRSCDLALL ETYCATPAKS ERDVSTPPTV LPDNFPRYPV GKFFQYDTWK 120

QSTQRLRRGL PALLRARRGH VLAKELEAFR EAKRHRPLIA LPTQDPAHGG APPEMASNRK
```

TABLE 20-continued

SEQ ID NO. 100 DNA sequence
Nucleic Acid Accession #: NM_004217.1
Coding sequence: 58..1092

```
1          11         21         31         41         51
|          |          |          |          |          |
GGCCGGGAGA GTAGCAGTGC CTTGGACCCC AGCTCTCCTC CCCCTTTCTC TCTAAGGATG   60

GCCCAGAAGG AGAACTCCTA CCCCTGGCCC TACGGCCGAC AGACGGCTCC ATCTGGCCTG  120

AGCACCCTGC CCCAGCGAGT CCTCCGGAAA GAGCCTGTCA CCCCATCTGC ACTTGTCCTC  180

ATGAGCCGCT CCAATGTCCA GCCCACAGCT GCCCCTGGCC AGAAGGTGAT GGAGAATAGC  240

AGTGGGACAC CGACATCTT AACGCGGCAC TTCACAATTG ATGACTTTGA GATTGGGCGT  300

CCTCTGGGCA AAGGCAAGTT TGGAAACGTG TACTTGGCTC GGGAGAAGAA AGCCATTTC   360

ATCGTGGCGC TCAAGGTCCT CTTCAAGTCC CAGATAGAGA AGGAGGGCGT GGAGCATCAG  420

CTGCGCAGAG AGATCGAAAT CCAGGCCCAC CTGCACCATC CAACATCCT GCGTCTCTAC   480

AACTATTTTT ATGACCGGAG GAGGATCTAC TTGATTCTAG AGTATGCCCC CGGCGGGGAG  540

CTCTACAAGG AGCTGCAGAA GAGCTGCACA TTTGACGAGC AGCGAACAGC CACGATCATG  600

GAGGAGTTGG CAGATGCTCT AATGTACTGC CATGGGAAGA AGGTGATTCA CAGAGACATA  660

AAGCCAGAAA ATCTGCTCTT AGGGCTCAAG GGAGAGCTGA AGATTGCTGA CTTCGGCTGG  720

TCTGTGCATG CGCCCTCCCT GAGGAGGAAG ACAATGTGTG GCACCCTGGA CTACCTGCCC  780

CCAGAGATGA TTGAGGGGCG CATGCACAAT GAGAAGGTGG ATCTGTGGTG CATTGGAGTG  840

CTTTGCTATG AGCTGCTGGT GGGGAACCCA CCCTTTGAGA GTGCATCACA CAACGAGACC  900

TATCGCCGCA TCGTCAAGGT GGACCTAAAG TTCCCCGCTT CTGTGCCCAC GGGAGCCCAG  960

GACCTCATCT CCAAACTGCT CAGGCATAAC CCCTCGGAAC GGCTGCCCCT GGCCCAGGTC 1020

TCAGCCCACC CTTGGGTCCG GGCCAACTCT CGGAGGGTGC TGCCTCCCTC TGCCCTTCAA 1080

TCTGTCGCCT GATGGTCCCT GTCATTCACT CGGGTGCGTG TGTTTGTATG TCTGTGTATG 1140

TATAGGGGAA AGAAGGGATC CCTAACTGTT CCCTTATCTG TTTTCTACCT CCTCCTTTGT 1200

TTAATAAAGG CTGAAGCTTT TTGT
```

SEQ ID NO: 101 Protein sequence
Protein Accession #: NP_004208

```
1          11         21         31         41         51
|          |          |          |          |          |
MAQKENSYPW PYGRQTAPSG LSTLPQRVLR KEPVTPSALV LMSRSNVQPT AAPGQKVMEN   60

SSGTPDILTR HFTIDDFEIG RPLGKGKFGN VYLAREKESH FIVALKVLFK SQIEKEGVEH  120

QLRREIEIQA HLHHPNILRL YNYFYDRRRI YLILEYAPRG ELYKELQKSC TFDEQRTATI  180

MEELADALMY CHGKKVIHRD IKPENLLLGL KGELKIADFG WSVHAPSLRR KTMCGTLDYL  240

PPEMIEGRMH NEKVDLWCIG VLCYELLVGN PPFESASHNE TYRRIVKVDL KFPASVPTGA  300

QDLISKLLRH NPSERLPLAQ VSAHPWVRAN SRRVLPPSAL QSVA
```

SEQ ID NO: 102 DNA sequence
Nucleic Acid Accession #. AK025790
Coding sequence 56..1642

```
1          11         21         31         41         51
|          |          |          |          |          |
AGTATCCCAG GAGGAGCAAG TGGCACGTCT TCGGACCTAG GCTGCCCCTG CCGTCATGTC   60

GCAAGGGATC CTTTCTCCGC CAGCGGGCTT GCTGTCCGAT GACGATGTCG TAGTTTCTCC  120

CATGTTTGAG TCCACAGCTG CAGATTTGGG GTCTGTGGTA CGCAAGAACC TGCTATCAGA  180

CTGCTCTGTC GTCTCTACCT CCCTAGAGGA CAAGCAGCAG GTTCCATCTG AGGACAGTAT  240

GGAGAAGGTG AAAGTATACT TGAGGGTTAG GCCCTTGTTA CCTTCAGAGT GGAACGACA   300

GGAAGATCAG GGTTGTGTCC GTATTGAGAA TGTGGAGACC CTTGTTCTAC AAGCACCCAA  360
```

TABLE 20-continued

```
GGACTCTTTT GCCCTGAAGA GCAATGAACG GGGAATTGGC CAAGCCACAC ACAGGTTCAC  420
CTTTTCCCAG ATCTTTGGGC CAGAAGTGGG ACAGGCATCC TTCTTCAACC TAACTGTGAA  480
GGAGATGGTA AAGGATGTAC TCAAAGGGCA GAACTGGCTC ATCTATACAT ATGGAGTCAC  540
TAACTCAGGG AAAACCCACA CGATTCAAGG TACCATCAAG GATGGAGGGA TTCTCCCCCG  600
GTCCCTGGCG CTGATCTTCA ATAGCCTCCA AGGCCAACTT CATCCAACAC CTGATCTGAA  660
GCCCTTGCTC TCCAATGAGG TAATCTGGCT AGACAGCAAG CAGATCCGAC AGGAGGAAAT  720
GAAGAAGCTG TCCCTGCTAA ATGGAGGCCT CCAAGAGGAG GAGCTGTCCA CTTCCTTGAA  780
GAGGAGTGTC TACATCGAAA GTCGGATAGG TACCAGCACC AGCTTCGACA GTGGCATTGC  840
TGGGCTCTCT TCTATCAGTC AGTGTACCAG CAGTAGCCAG CTGGATGAAA CAAGTCATCG  900
ATGGGCACAG CCAGACACTC CCCCACTACC TGTCCCGGCA AACATTCGCT CTCCATCTG  960
GATCTCATTC TTTGAGATCT ACAACGAACT GCTTTATGAC CTATTAGAAC CGCCTAGCCA 1020
ACAGCGCAAG AGGCAGACTT TGCGGCTATG CGAGGATCAA AATGGCAATC CCTATGTGAA 1080
AGATCTCAAC TGGATTCATG TGCAAGATGC TGAGGAGGCC TGGAAGCTCC TAAAAGTGGG 1140
TCGTAAGAAC CAGAGCTTTG CCAGCACCCA CCTCAACCAG AACTCCAGCC GCAGTCACAG 1200
CATCTTCTCA ATCAGGATCC TAGACCTTCA GGGGGAAGGA GATATAGTCC CCAAGATCAG 1260
CGAGCTGTCA CTCTGTGATC TGGCTGGCTC AGAGCGCTGC AAAGATCAGA GAGTGGTGA  1320
ACGGTTGAAG GAAGCAGGAA ACATTAACAC CTCTCTACAC ACCCTGGGCC GCTGTATTGC 1380
TGCCCTTCGT CAAAACCAGC AGAACCGGTC AAAGCAGAAC CTGGTTCCCT TCCGTGACAG 1440
CAAGTTGACT CGAGTGTTCC AAGGTTTCTT CACAGGCCGA GGCCGTTCCT GCATGATTGT 1500
CAATGTGAAT CCCTGTGCAT CTACCTATGA TGAAACTCTT CATGTGGCCA AGTTCTCAGC 1560
CATTGCTAGC CAGGTGACTT GTGCATGCCC CACCTATGCA ACTGGGATTC CCATCCCTGC 1620
ACTCGTTCAT CAAGGAACAT AGTCTTCAGG TATCCCCCAG CTTAGAGAAA GGGGCTAAGG 1680
CAGACACAGG CCTTCATGAT GATATTGAAA ATGAAGCTGA CATCTCCATG TATGGCAAAG 1740
AGGAGCTCCT ACAAGTTGTG GAAGCCATGA AGACACTGCT TTTGAAGGAA CGACAGGAAA 1800
AGCTACAGCT GGAGATGCAT CTCCGAGATG AAATTTGCAA TGAGATGGTA GAACAGATGC 1860
AACAGCGGGA ACAGTGGTGC AGTGAACATT TGGACACCCA AAAGGAACTA TTGGAGGAAA 1920
TGTATGAAGA AAAACTAAAT ATCCTCAAGG AGTCACTGAC AAGTTTTTAC CAAGAAGAGA 1980
TTCAGGAGCG GGATGAAAAG ATTGAAGAGC TAGAAGCTCT CTTGCAGGAA GCCAGACAAC 2040
AGTCAGTGGC CCATCAGCAA TCAGGGTCTG AATTGGCCCT ACGGCGGTCA CAAAGGTTGG 2100
CAGCTTCTGC CTCCACCCAG CAGCTTCAGG AGGTTAAAGC TAAATTACAG CAGTGCAAAG 2160
CAGAGCTAAA CTCTACCACT GAAGAGTTGC ATAAGTATCA GAAAATGTTA GAACCACCAC 2220
CCTCAGCCAA GCCCTTCACC ATTGATGTGG ACAAGAAGTT AGAAGAGGGC CAGAAGAATA 2280
TAAGGCTGTT GCGGACAGAG CTTCAGAAAC TTGGTGAGTC TCTCCAATCA GCAGAGAGAG 2340
CTTGTTGCCA CAGCACTGGG GCAGGAAAAC TTCGTCAAGC CTTGACCACT TGTGATGACA 2400
TCTTAATCAA ACAGGACCAG ACTCTGGCTG AACTGCAGAA CAACATGGTG CTAGTGAAAC 2460
TGGACCTTCG GAAGAAGGCA GCATGTATTG CTGAGCAGTA TCATACTGTG TTGAAACTCC 2520
AAGGCCAGGT TTCTGCCAAA AAGCGCCTTG GTACCAACCA GGAAAATCAG CAACCAAACC 2580
AACAACCACC AGGGAAGAAA CCATTCCTTC GAAATTTACT TCCCCGAACA CCAACCTGCC 2640
AAAGCTCAAC AGACTGCAGC CCTTATGCCC GGATCCTACG CTCACGGCGT TCCCCTTTAC 2700
TCAAATCTGG GCCTTTTGGC AAAAAGTACT AAGGCTGTGG GGAAAGAGAA GAGCAGTCAT 2760
```

TABLE 20-continued

```
GGCCCTGAGG TGGGTCAGCT ACTCTCCTGA AGAAATAGGT CTCTTTTATG CTTTACCATA  2820

TATCAGGAAT TATATCCAGG ATGCAATACT CAGACACTAG CTTTTTTCTC ACTTTTGTAT  2880

TATAACCACC TATGTAATCT CATGTTGTTG TTTTTTTTTA TTTACTTATA TGATTTCTAT  2940

GCACACAAAA ACAGTTATAT TAAAGATATT ATTGTTCACA TTTTTTATTG AATTCCAAAT  3000

GTAGCAAAAT CATTAAAACA AATTATAAAA GGGACAGAAA AA

SEQ ID NO: 103 Protein sequence
Protein Accession #: NP_005724.1
1          11         21         31         41         51
|          |          |          |          |          |
MSQGILSPPA GLLSDDDVVV SPMFESTAAD LGSVVRKNLL SDCSVVSTSL EDKQQVPSED   60

SMEKVKVYLR VRPLLPSELE RQEDQGCVRI ENVETLVLQA PKDSFALKSN ERGIGQATHR  120

FTFSQIFGPE VGQASFFNLT VKEMVKDVLK GQNWLIYTYG VTNSGKTHTI QGTIKGGGIL  180

PRSLALIFNS LQGQLHPTPD LKPLLSNEVI WLDSKQIRQE EMKKLSLLNG GLQEEELSTS  240

LKRSVYIESR IGTSTSFDSG IAGLSSISQC TSSSQLDETS HRWAQPDTAP LPVPANIRFS  300

IWISFFEIYN ELLYDLLEPP SQQRKRQTLR LCEDQNGNPY VKDLNWIHVQ DAEEAWKLLK  360

VGRKNQSFAS THLNQNSSRS HSIFSIRILH LQGEGDIVPK ISELSLCDLA GSERCKDQKS  420

GERLKEAGNI NTSLHTLGRC IAALRQNQQN RSKQNLVPFR DSKLTRVFQG FFTGRGRSCM  480

IVNVNPCAST YDETLHVAKF SAIASQVTCA CPTYATGIPI PALVHQGT

SEQ ID NO: 104 DNA sequence
Nucleic Acid Accession #: NM_006952.1
Coding sequence: 11. .793
1          11         21         31         41         51
|          |          |          |          |          |
AATCCCGACA ATGGCGAAAC ACAACTCAAC TGTTCGTTGC TTCCAGGGCC TGCTGATTTT   60

TGGAAATGTG ATTATTGGTT GTTCCGGCAT TGCCCTGACT GCGGAGTGCA TCTTCTTTGT  120

ATCTGACCAA CACAGCCTCT ACCCACTGCT TGAAGCCACC GACAACGATG ACATCTATGG  180

GGCTGCCTGG ATCGGCATAT TTGTGGGCAT CTGCCTCTTC TGCCTGTCTG TTCTAGGCAT  240

TGTAGGCATC ATGAACTCCA GCAGGAAAAT TCTTCTGGCG TATTTCATTC TGATCTTTAT  300

AGTATATGCC TTTGAAGTGG CATCTTGTAT CACAGCAGCA ACACAACGAG ACTTTTTCAC  360

ACCCAACCTC TTCCTGAAGC AGATGCTAGA GAGGTACCAA AACAACAGCC CTCCAAACAA  420

TCATGACCAG TGGAAAAACA ATGGAGTCAC CAAAACCTGG GACAGGCTCA TGCTCCAGGA  480

CAATTGCTGT GGCGTAAATG GTCCATCAGA CTGGCAAAAA TACACATCTG CCTTCCGGAC  540

TGAGAATAAT GATGCTGACT ATCCCTGGCC TCGTCAATGC TGTGTTATGA ACAATCTTAA  600

AGAACCTCTC AACCTGGAGG CTTGTAAACT AGGCGTGCCT GGTTTTTATC ACAATCAGGG  660

CTGCTATGAA CTGATCTCTG GTCCAATGAA CCGACACGCC TGGGGGGTTG CCTCGTTTGC  720

ATTTGCCATT CTCTGCTGGA CTTTTTGGGT TCTCCTGGGT ACCATGTTCT ACTGGAGCAG  780

AATTGAATAT TAAGAA

SEQ ID NO: 105 Protein sequence
Protein Accession #. NP_008883.1
1          11         21         31         41         51
|          |          |          |          |          |
MAKDNSTVRC FQGLLIFGNV IIGCCGIALT AECIFFVSDQ HSLYPLLEAT DNDDIYGAAW   60

IGIFVGICLF CLSVLGIVGI MKSSRKILLA YFILMFIVYA FEVASCITAA TQRDFFTPNL  120

FLKQMLERYQ NNSPPNNDDQ WKNNGVTKTW DRLMLQDNCC GVNGPSDWQK YTSAFRTENN  180

DADYPWPRQC CVMNNLKEPL NLEACKLGVP GFYHNQGCYE LISGPMNRHA WGVAMFGPAI  240

LCWTFWVLLG TMFYWSRIEY
```

TABLE 20-continued

```
SEQ ID NO: 106 DNA sequence
Nucleic Acid Accession #: NM_002740.1
Coding sequence: 178..1968
1         11        21        31        41        51
|         |         |         |         |         |
CCGCGGTTCC GGCTGCTCCG GCGAGGCGAC CCTTGGGTCG GCGCTGCGGG CGAGGTGGGC   60

AGGTAGGTGG GCGGACGGCC GCGGTTCTCC GGCAAGCGCA GGCGGCGGAG TCCCCCACCG  120

CGCCCGAAGC GCCCCCCGCA CCCCCGGCCT CCAGCGTTGA GGGGGGGGAG TGAGGAGATG  180

CCGACCCAGA GGGACAGCAG CACCATGTCC CACACGGTCG CAGGCGGCGG CAGCGGGGAC  240

CATTCCCACC AGGTCCGGGT GAAAGCCTAC TACCGCGGGG ATATCATGAT AACACATTTT  300

GAACCTTCCA TCTCCTTTGA GGGCCTTTGC AATGAGGTTC GAGACATGTG TTCTTTTGAC  360

AACGAACAGC TCTTCACCAT GAAATGGATA GATGAGGAAG GAGACCCGTG TACAGTATCA  420

TCTCAGTTGG AGTTAGAAGA AGCCTTTAGA CTTTATGAGC TAAACAAGGA TTCTGAACTC  480

TTGATTCATG TGTTCCCTTG TGTACCAGAA CGTCCTGGGA TGCCTTGTCC AGGAGAAGAT  540

AAATCCATCT ACCGTAGAGG TGCACGCCGC TGGAGAAAGC TTTATTGTGC CAATGGCCAC  600

ACTTTCCAAG CCAAGCGTTT CAACAGGCGT GCTCACTGTG CCATCTGCAC AGACCGAATA  660

TGGGGACTTG GACGCCAAGG ATATAAGTGC ATCAACTGCA AACTCTTGGT TCATAAGAAG  720

TGCCATAAAC TCGTCACAAT TGAATGTGGG CGGCATTCTT GCCACAGGA ACCAGTGATG  780

CCCATGGATC AGTCATCCAT GCATTCTGAC CATGCACAGA CAGTAATTCC ATATAATCCT  840

TCAAGTCATG AGAGTTTGGA TCAAGTTGGT GAAGAAAAAG AGGCAATGAA CACCAGGGAA  900

AGTGGCAAAG CTTCATCCAG TCTAGGTCTT CAGGATTTTG ATTTGCTCCG GGTAATAGGA  960

AGAGGAAGTT ATGCCAAAGT ACTGTTGGTT CGATTAAAAA AAACAGATCG TATTTATGCA 1020

ATGAAAGTTG TGAAAAAAGA GCTTGTTAAT GATGATGAGG ATATTGATTG GGTACAGACA 1080

GAGAAGCATG TGTTTGAGCA GGCATCCAAT CATCCTTTCC TTGTTGGGCT GCATTCTTGC 1140

TTTCAGACAG AAAGCAGATT GTTCTTTGTT ATAGAGTATG TAAATGGAGG AGACCTAATG 1200

TTTCATATGC AGCGACAAAG AAAACTTCCT GAAGAACATG CCAGATTTTA CTCTGCAGAA 1260

ATCAGTCTAG CATTAAATTA TCTTCATGAG CGAGGGATAA TTTATAGAGA TTTGAAACTG 1320

GACAATGTAT TACTGGACTC TGAAGGCCAC ATTAAACTCA CTGACTACGG CATGTGTAAG 1380

GAAGGATTAC GGCCAGGAGA TACAACCAGC ACTTTCTGTG GTACTCCTAA TTACATTGCT 1440

CCTGAAATTT TAAGAGGAGA AGATTATGGT TTCAGTGTTG ACTGGTGGGC TCTTGGAGTG 1500

CTCATGTTTG AGATGATGGC AGGAAGGTCT CCATTTGATA TTGTTGGGAG CTCCGATAAC 1560

CCTGACCAGA ACACAGAGGA TTATCTCTTC CAAGTTATTT TGGAAAAACA AATTCGCATA 1620

CCACGTTCTC TGTCTGTAAA AGCTGCAAGT GTTCTGAAGA GTTTTCTTAA TAAGGACCCT 1080

AAGGAACGAT TGGGTTGTCA TCCTCAAACA GGATTTGCTG ATATTCAGGG ACACCCGTTC 1740

TTCCGAAATG TTGATTGGGA TATGATGGAG CAAAAACAGG TGGTACCTCC CTTTAAACCA 1800

AATATTTCTG GGGAATTTGG TTTGGACAAC TTTGATTCTC AGTTTACTAA TGAACCTGTC 1860

CAGCTCACTC CAGATGACGA TGACATTGTG AGGAAGATTG ATCAGTCTGA ATTTGAAGGT 1920

TTTGAGTATA TCAATCCTCT TTTGATGTCT GCAGAAGAAT GTGTCTGATC CTCATTTTTC 1980

AACCATGTAT TCTACTCATG TTGCCATTTA ATGCATGGAT AAACTTGCTG CAAGCCTGGA 2040

TACAATTAAC CATTTTATAT TTGCCACCTA CAAAAAAACA CCCAATATCT TCTCTTGTAG 2100

ACTATATGAA TCAATTATTA CATCTGTTTT ACTATGAAAA AAAAATTAAT ACTACTAGCT 2160
```

TABLE 20-continued

```
TCCAGACAAT CATGTCAAAA TTTAGTTGAA CTGGTTTTTC AGTTTTTAAA AGGCCTACAG  2220

ATGAGTAATG AAGTTACCTT TTTTGTTTAA AAAAAAAAAA G

SEQ ID NO: 107 Protein sequence
Protein Accession #: NP_002731.1
1          11         21         31         41         51
|          |          |          |          |          |
MSNTVAGGGS GDHSHQVRVK AYYRGDIMIT HFEPSISFEG LCNEVRDMCS FDNEQLFTMK   60

WIDEEGDPCT VSSQLELEEA FRLYELNKDS ELLIHVFPCV PERPGMPCPG EDKSIYRRGA  120

RRWRKLYCAN GHTFQAKRFN RRAHCAICTD RIWGLGRQGY KCINCKLLVH KKCHKLVTIE  160

CGRHSLPQEP VMPMDQSSMH SDHAQTVIPY NPSSHESLDQ VGEEKEAMNT RESGKASSSL  240

GLQDFDLLRV IGRGSYAKVL LVRLKKTDRI YAMKVVKKEL VNDDEDIDWV QTEKHVFEQA  300

SNHPFLVGLH SCFQTESRLF FVIEYVNGGD LMFHMQRQRK LPEEHARFYS AEISLALNYL  360

HERGIIYRDL KLDNVLLDSE GHIKLTDYGM CKEGLRPGDT TSTFCGTPNY IAPEILRGED  420

YGFSVDWWAL GVLMFEMMAG RSPFDIVGSS DNPDQNTEDY LFQVILEKQI RIPRSLSVKA  480

ASVLKSFLNK DPKERLGCHP QTGFADIQGH PFFRNVDWDM MEQKQVVPPF KPNISGEFGL  540

DNFDSQFTNE PVQLTPDDDD IVRKIDQSEF EGFEYINPLL MSAEECV

SEQ ID NO: 108 DNA sequence
Nucleic Acid Accession #: NM_000349.1
Coding sequence: 127..984
1          11         21         31         41         51
|          |          |          |          |          |
GGGACTCAGA GGCGAAGCTT GAGGGGCTCA GGAAGGACGA AGAACCACCC TTGAGAGAAG   60

AGGCAGCAGC AGCCGCGGCA GCAGCAGCGG CAGCGACCCC ACCACTGCCA CATTTGCCAG  120

GAAACAATGC TGCTAGCGAC ATTCAAGCTG TGCGCTGGGA GCTCCTACAG ACACATGCGC  160

AACATGAAGG GGCTGAGGCA ACAGGCTGTG ATGGCCATCA GCCAGGAGCT GAACCGGAGG  240

GCCCTGGGGG GCCCCACCCC TAGCACGTGG ATTAACCAGG TTCGGCGGCG GAGCTCTCTA  300

CTCGGTTCTC GGCTGGAAGA GACTCTCTAC AGTGACCAGG AGCTGGCCTA TCTCCAGCAG  360

GGGGAGGAGG CCATGCAGAA GGCCTTGGGC ATCCTTAGCA ACCAAGAGGG CTGGAAGAAG  420

GAGAGTCAGC AGGACAATGG GGACAAAGTG ATGAGTAAAG TGGTCCCAGA TGTGGGCAAG  480

GTGTTCCGGC TGGAGGTCGT GGTGGACCAG CCCATGGAGA GGCTCTATGA AGAGCTCGTG  540

GAGCGCATGG AAGCAATGGG GGAGTGGAAC CCCAATGTCA AGGAGATCAA GGTCCTGCAG  600

AAGATCGGAA AAGATACATT CATTACTCAC GAGCTGGCTG CCGAGGCAGC AGGAAACCTG  660

GTGGGGCCCC GTGACTTTGT GAGCGTGCGC TGTGCCAAGC GCCAGGGCTC CACCTGTGTG  720

CTGGCTGGCA TGGACACAGA CTTCGGGAAC ATGCCTGAGC AGAAGGGTGT CATCAGGGCG  780

GAGCACGGTC CCACTTGCAT GGTGCTTCAC CCGTTGGCTG AAGTCCCTC TAAGACCAAA  840

CTTACGTGGC TACTCAGCAT CGACCTCAAG GGGTGGCTGC CCAAGAGCAT CATCAACCAG  900

GTCCTGTCCC AGACCCAGGT GGATTTTGCC AACCACCTGC GCAAGCGCCT GGAGTCCCAC  960

CCTGCCTCTG AAGCCAGGTG TTGAAGACCA GCCTGCTGTT CCCAACTGTG CCCAGCTGCA 1020

CTGGTACACA CGCTCATCAG GAGAATCCCT ACTGGAAGCC TGCAAGTCTA AGATCTCCAT 1080

CTGGTGACAG TGGGATGGGT GGGGTTCGTG TTTAGAGTAT GACACTAGGA TTCAGATTGG 1140

TGAAGTTTTT AGTACCAAGA AAACAGGGAT GAGGCTCTTG GATTAAAAGG TAACTTCATT 1200

CACTGATTAG CTATGACATG AGGGTTCAGG CCCCTAAAAT AATTGTAAAA CTTTTTTTCT 1260

GGGCCCTTAT GTACCCACCT AAAACCATCT TTAAAATGCT AGTGGCTGAT ATGGGTGTGG 1320

GGGATGCTAA CCACAGGGCC TGAGAAGTCT TGCTTTATGG GCTCAAGAAT GCCATGCGCT 1380
```

TABLE 20-continued

```
GGCACTACAT GTGCACAAAG CAGAATCTCA GAGGGTCTCC TGCAGCCCTC TGCTCCTCCC  1440

GGCCGCTGCA CAGCAACACC ACAGAACAAG CAGCACCCCA CAGTGGGTGC CTTCCAGAAA  1500

TATAGTCCAA GCTTTCTCTG TGGAAAAAGA CAAAACTCAT TACTAGACAT GTTTCCCTAT  1560

TGCTTTCATA GGCACCAGTC AGAATAAAGA ATCATAATTC ACACC

SEQ ID NO: 109 Protein sequence
Protein Accession #: NP_000340.1
1          11         21         31         41         51
|          |          |          |          |          |
MLLATFKLCA GSSYRHMRNM KGLRQQAVMA ISQELNRRAL GGPTPSTWIN QVRRRSSLLG  60

SRLEETLYSD QELAYLQQGE EAMQKALGIL SNQEGWKKES QQDNGDKVMS KVVPDVGKVF  120

RLEVVVDQPM ERLYEELVER MEAMGEWNPN VKEIKVLQKI GKDTFITHEL AAEAAGNLVG  180

PRDFVSVRCA KRRGSTCVLA GMDTDFGNMP EQKGVIRAEH GPTCMVLHPL AGSPSKTKLT  240

WLLSIDLKGW LPKSIINQVL SQTQVDFANH LRKRLESHPA SEARC

SEQ ID NO: 110 DNA sequence
Nucleic Acid Accession #: EOS sequence
Coding sequence: 131-682
1          11         21         31         41         51
|          |          |          |          |          |
GCTGGGAGCC TGGGCCGGGA GCCGGGTGAG GGCGCCGAGA GGCTCGGTGG GCGCGGGCGG  60

CGAGATATGC CACACTTCTG CCTGCTGTTG GCAACCCTCC TGGACTAGGC TGCTCTTGTT  120

AATCACATGG ATGTTATATA AGAGTTCGGA CCGCCCAGCA CACAAGGTCA GCATGCTGCT  180

CCTCTGTCAC GCTCTCGCTA TAGCTGTTGT CCAGATCGTT ATCTTCTCAG AAAGCTGGGC  240

ATTTGCCAAG AACATCAACT TCTATAATGT GAGGCCTCCT CTCGACCCTA CACCATTTCC  300

AAATAGCTTC AAGTGCTTTA CTTGTGAAAA CGCAGGGGAT AATTATAACT GCAATCGATG  360

GGCAGAAGAC AAATGGTGTC CACAAAATAC ACAGTACTGT TTGACAGTTC ATCACTTCAC  420

CAGCCACGGA AGAAGCACAT CCATCACCAA AAAGTGTGCC TCCAGAAGTG AATGTCATTT  480

TGTCGGTTGC CACCACAGCC GAGATTCTGA ACATACGGAG TGTAGGTCTT GCTGTGAAGG  540

AATGATCTGC AATGTAGAAT TACCCACCAA TCACACTAAT GCAGTGTTTG CCGTAATGCA  600

CGCTCAGAGA ACATCTGGCA GCAGTGCCCC CACACTCTAC CTACCAGTGC TTGCCTGGGT  660

CTTTGTGCTT CCATTGCTGT GATGCCACCA TTCCTAGGAG AGGCAGAGAC CAGCCTCTAA  720

AGCACAAGCC AAAAACTGTG TGAACGGTGA ACTTTGGAGT GAAGATCAAT CTTGCACTTG  780

GTGAAGAGTG CACATTGGAC CTCAAGGCGA AAGCCAGTGG TTTGCTTGGA TAAAATGTTC  840

CCGCATGAGG CCACAGGACT GAGGATGGGA ATTTGGCAGG GCCTGAGAAG ATGGTCTGAC  900

TTCCAGGCTT CCTGGTCAAA GAGAGCTACG TTTGGGCAGT TCTGCAGAGA GGATCCTGGC  960

AACTAGTCCC ACCTGACTAG GCCTTTAGCT GAAAGGATTT CTTGACCTCC TTGACTGCCT  1020

CAGAGGCTGC CAGGTCAAAC CCTCTTGTTT ATGTGATTAG CTCAGAGCAT CTCTATGAAA  1080

TCTAACCCTT CCCCTCATGA GAAAGCAGTT TTCCCCACCA ACAGCATAGT CAATGAGAAA  1140

GGCAACTGTA CGAAGAAAAC TTCCAGTGGA ACTAATATGA AATCTATTTG CAAATTATGG  1200

GGGGAAATAA AGCTTTTAAA TTATACAATG T

SEQ ID NO: 111 Protein sequence
Protein Accession #: AAM20908.1
1          11         21         31         41         51
|          |          |          |          |          |
MLYKSSDRPA HKVSMLLLCH ALAIAVVQIV IFSESWAFAK NINFYNVRPP LDPTPFPNSF  60

KCFTCENAGD NYNGNRWAED KWCPQNTQYC LTVHHFTSHG RSTSITKKCA SRSECHFVGC  120
```

TABLE 20-continued

```
HHSRDSEHTE CRSCCEGMIC NVELPTNHTN AVFAVMHAQR TSGSSAPTLY LPVLAWVFVL    180

PLL

SEQ ID NO: 112 DNA sequence
Nucleic Acid Accession #: Eos sequence
Coding sequence: 228-884
1          11         21         31         41         51
|          |          |          |          |          |
CGCCCGCCGG CCCCAGGCGG GTGCGCTGGG AGCCTGGGCC GGGAGCCGGG TGAGGGCGCC    60

GAGAGGCTCG GTGGGCGCGG GCGGCGAGGA CTCTGCTGGA GCAGGACTTC AGAGTGTTTG    120

TTTTCAGCCT GCTTTTAAAG TCATTTGAAG AGAGCGGCTT TCAAGATATG CCACACTTCT    180

GCCTGCTGTT GGCAACCCTC CTGGACTAGG CTGCTCTTGT TAATCACATG GATGTTGCTG    240

ATTACTCTGA GTGCAAACCT TTTCACTGTT CCAGAGAGGA GCCTGACAAC CACATTCTCC    300

TTCTCAAGGT GTGGTGCTTA CTGCGCAGGC TGACCAGATA TAAGAGTTCG GACCGCCCAG    360

CACACAAGGT CAGCATGCTG CTCCTCTGTC ACGCTCTCGC TATAGCTGTT GTCCAGATCG    420

TTATCTTCTC AGAAAGCTGG GCATTTGCCA AGAACATCAA CTTCTATAAT GTGAGGCCTC    480

CTCTCGACCC TACACCATTT CCAAATAGCT TCAAGTGCTT TACTTGTGAA AACGCAGGGG    540

ATAATTATAA CTGCAATCGA TGGGCAGAAG ACAAATGGTG TCCACAAAAT ACACACTACT    600

GTTTGACAGT TCATCACTTC ACCAGCCACG GAAGAAGCAC ATCCATCACC AAAAAGTGTG    660

CCTCCAGAAG TGAATGTCAT TTTGTCGGTT GCCACCACAG CCCAGATTCT GAACATACGG    720

AGTGTAGGTC TTGCTGTGAA GGAATGATCT GCAATGTAGA ATTACCCACC AATCACACTA    780

ATGCAGTCTT TGCCGTAATG CACGCTCAGA GAACATCTGG CAGCAGTGCC CCCACACTCT    840

ACCTACCAGT GCTTGCCTGG GTCTTTGTGC TTCCATTGCT GTGATGCCAC CATTCCTAGG    900

AGAGGCAGAG ACCAGCCTCT AAAGCACAAG CCAAAAACTG TGTGAACGGT GAACTTTGGA    960

GTGAAGATCA ATCTTGCACT TGGTGAAGAG TGCACATTGG ACCTCAAGGC GAAAGCCAGT    1020

GGTTTGCTTG GATAAAATGT TCCCGCATGA GGCCACAGGA CTGAGGATGG GAATTTGGCA    1080

GGGCCTGAGA AGATGGTCTG ACTTCCAGGC TTCCTGGTCA AGAGAGCTA CGTTTGGGCA    1140

GTTCTGCAGA GAGGATCCTG GCAACTAGTC CCACCTGACT AGGCCTTTAG CTGAAAGGAT    1200

TTCTTGACCT CCTTGACTGC CTCAGAGGCT GCCAGGTCAA ACCCTCTTGT TTATGTGATT    1260

AGCTCAGAGC ATCTCTATGA AATCTAACCC TTCCCCTCAT GAGAAAGCAG TTTTCCCCAC    1320

CAACAGCATA GTCAATGAGA AAGGCAACTG TACGAAGAAA ACTTCCAGTG AACTAATAT     1380

GAAATCTATT TGCAAATTAT GGGGGAAAT AAAGCTTTTA AATTATAAA

SEQ ID NO: 113 Protein sequence
Protein Accession #: Eos sequence
1          11         21         31         41         51
|          |          |          |          |          |
MDVADYSECK PFHCSREEPD NHILLLKVWC LLRRLTRYKS SDRPAHKVSM LLLCHALAIA    60

VVQIVIFSES WAFAKNINFY NVRPPLDPTP FPNSFKCFTC ENAGDNYNCN RWAEDKWCPQ    120

NTQYCLTVHH FTSHGRSTSI TKKCASRSEC HFVGCHHSRD SEHTECRSCC EGMICNVELP    180

TNHTNAVFAV MHAQRTSGSS APTLYLPVLA WVFVLPLL

SEQ ID NO: 114 DNA sequence
Nucleic Acid Accession #: EOS sequence
Coding sequence: 402-1025
1          11         21         31         41         51
|          |          |          |          |          |
ACTTCCTGAG CCGGGCTGGC TGGGTGGGAA CAGGCTCCTT GCCGCCTCCC CAGCGCTGGC    60

CACTACCACA CTGCCGCCCG CCTGGGCCTC CTTTCAACCT CGTGGTGGAG CCCTGCCGTT    120

TCCCAGCGGA GCCGGGCCCG GGGCTGCTCC CTCGCGGGCG AGGCTCACCT GTCCCGGCCC    180
```

TABLE 20-continued

```
GGCCCCCTCC CGCGCCCCAG GTGGTTCAGG GCAGGGAGGA GCCGCGCCCC GCCCCGCGCG  240

GTAGCAGCCA ACGCCGGCCC CAGGCGGGTG CGCTGGGAGC CTGGGCCGGG AGCCGGGTGA  300

GGGCGCCGAG AGGCTCGGTG GGCGCGGGCG GCGAGATATG CCACACTTCT GCCTGCTGTT  360

GGCAACCCTC CTGGACTAGG CTGCTCTTGT TAATCACATG GATGTTGCTG ATTACTCTGA  420

GTGCAAACCT TTTCACTGTT CCAGAGAGGA GCCTGACAAC CACATTCTCC TTCTCAAGAT  480

ATAAGAGTTC GGACCGCCCA GCACACAAGG TCAGCATGCT GCTCCTCTGT CACGCTCTCG  540

CTATAGCTGT TGTCCAGATC GTTATCTTCT CAGAAAGCTG GGCATTTGCC AAGAACATCA  600

ACTTCTATAA TGTGAGGCCT CCTCTCGACC CTACACCATT TCCAAATAGC TTCAAGTGCT  660

TTACTTGTGA AAACGCAGGG GATAATTATA ACTGCAATCG ATGGGCAGAA GACAAATGGT  720

GTCCACAAAA TACACAGTAC TGTTTGACAG TTCATCACTT CACCAGCCAC GGAAGAAGCA  780

CATCCATCAC CAAAAAGTGT GCCTCCAGAA GTGAATGTCA TTTTGTCGGT TGCCACCACA  840

GCCGAGATTC TGAACATACG GAGTGTAGGT CTTGCTGTGA AGGAATGATC TGCAATGTAG  900

AATTACCCAC CAATCACACT AATGCAGTGT TTGCCGTAAT GCACGCTCAG AGAACATCTG  960

GCAGCAGTGC CCCCACACTC TACCTACCAG TGCTTGCCTG GGTCTTTGTG CTTCCATTGC 1020

TGTGATGCCA CCATTCCTAG GAGAGGCAGA GACCAGCCTC TAAAGCACAA GCCAAAAACT 1080

GTGTGAACGG TGAACTTTGG AGTGAAGATC AATCTTGCAC TTGGTGAAGA GTGCACATTG 1140

GACCTCAAGG CGAAAGCCAG TGGTTTGCTT GGATAAAATG TTCCCGCATG AGGCCACAGG 1200

ACTGAGGATG GGAATTTGGC AGGGCCTGAG AAGATGGTCT GACTTCCAGG CTTCCTGGTC 1260

AAAGAGAGCT ACGTTTGGGC AGTTCTGCAG AGAGGATCCT GGCAACTAGT CCCACCTGAC 1320

TAGGCCTTTA GCTGAAAGGA TTTCTTGACC TCCTTGACTG CCTCAGAGGC TGCCAGGTCA 1380

AACCCTCTTG TTTATGTGAT TAGCTCAGAG CATCTCTATG AAATCTAACC CTTCCCCTCA 1440

TGAGAAAGCA GTTTTCCCCA CCAACAGCAT AGTCAATGAG AAAGGCAACT GTACGAAGAA 1500

AACTTCCAGT GGAACTAATA TGAAATCTAT TTGCAAATTA TGGGGGAAA TAAAGCTTTT 1560

AAATTATACA ATGT
```

SEQ ID NO: 115 Protein sequence
Protein Accession #: EOS sequence

```
1          11         21         31         41         51
|          |          |          |          |          |
MLLITLSANL FTVPERSLTT TFSFSRYKSS DRPAHKVSML LLCHALAIAV VQIVTFSESW   60

AFAKNINFYN VRPPLDPTPF PNSFKCFTCE NAGDNYNCNR WAEDKWCPQN TQYCLTVHHF  120

TSHGRSTSIT KKCASRSECH FVGCHHSRDS EHTECRSCCE GMICNVELPT NHTNAVFAVM  180

HAQRTSGSSA PTLYLPVLAW VFVLP
```

SEQ ID NO: 116 DNA sequence
Nucleic Acid Accession #: Eos sequence
Coding sequence: 1-1059

```
1          11         21         31         41         51
|          |          |          |          |          |
ATGGTATGGC AGCAAGATTA TGGAACCAGG AGAGAGCACC ATGGCTGCCG TCTGGAATTC   60

TGCCGTGTAT CTGCAGGGTG CCCTTGCCTA AGCCCCTTGA CCTCTTTGGT TATAGTTTCC  120

TCATGTGCTG AGAGAGGTGA GGAAGCTGCA GAAGAAGACT TTGAAACTAG CAGAGGTGGG  180

TTCATGAGGA TGAAGGAAAG AAGCCATGCC CATAACATAA AGTGCAAGG TGAAGCAGGA  240

GGTGCTGATG AAGAAGCTGC AGCAAGTGAT CCAGAAGATC TAGCTAAGAT CATTGATGAA  300

GATGTGAAAG GCATTGTACA GAAGAAGATG AGAATCACAG TAAACCAAAC AAAGGAAATG  360

CAGAAGAGAT ATTTTCAGCT GAATATTGGA AATGTAAAAT GCCACACGTT GGATGAGATG  420
```

TABLE 20-continued

```
ATTATCCGAG CTCAGACTTG GGAAATAGTC ATGCTTCTGG ACCAAGTGCC AGGTCCTGGC  480
CCTACACAAC AGGTAGATGG TTGGATATAT TTGGATAATG GAGCTTTCCA AACAGAAGCA  540
AAACACAAAC CCACTGATGT AAAATATAAA GAAACTGAAC CAGTGTGTCT TTTCACCATA  600
GATATAAGAG TTCGGACCGC CCAGCACACA AGAATAAAAC AGAAAGTCTC CATTACTTCT  660
ATGGCTACAC CATTTCCAAA TAGCTTCAAG TGCTTTACTT GTGAAAACGC AGGGGATAAT  720
TATAACTGCA ATCGATGGGC AGAAGACAAA TGGTGTCCAC AAAATACACA GTACTGTTTG  780
ACAGTTCATC ACTTCACCAG CCACGGAAGA AGCACATCCA TCACCAAAAA GTGTGCCTCC  840
AGAAGTGAAT GTCATTTTGT CGGTTGCCAC CACAGCCGAG ATTCTGAACA TACGGAGTGT  900
AGGTCTTGCT GTGAAGGAAT GATCTGCAAT GTAGAATTAC CCACCAATCA CACTAATGCA  960
GTGTTTGCCG TAATGCACGC TCAGAGAACA TCTGGCAGCA GTGCCCCCAC ACTCTACCTA 1020
CCAGTGCTTG CCTGGGTCTT TGTGCTTCCA TTGCTGTGAT GCCACCATTC CTAGGAGAGG 1080
CAGAGACCAG CCTCTAAAGC ACAAGCCAAA AACTGTGTGA ACGGTGAACT TTGGAGTGAA 1140
GATCAATCTT GCACTTGGTG AAGAGTGCAC ATTGGACCTC AAGGCGAAAG CCAGTGGTTT 1200
GCTTGGATAA AATGTTCCCG CATGAGGCCA CAGGACTGAG GATGGGAATT TGGCAGGGCC 1260
TGAGAAGATG GTCTGACTTC CAGGCTTCCT GGTCAAAGAG AGCTACGTTT GGGCAGTTCT 1320
GCAGAGAGGA TCCTGGCAAC TAGTCCCACC TGACTAGGCC TTTAGCTGAA AGGATTTCTT 1380
GACCTCCTTG ACTGCCTCAG AGGCTGCCAG GTCAAACCCT CTTGTTTATG TGATTAGCTC 1440
AGAGCATCTC TATGAAATCT AACCCTTCCC CTCATGAGAA AGCAGTTTTC CCCACCAACA 1500
GCATAGTCAA TGAGAAAGGC AACTGTACGA AGAAAACTTC CAGTGGAACT AATATGAAAT 1560
CTATTTGCAA ATTATGGGGG GAAATAAAGC TTTTAAATTA TACAATGTAA A
```

SEQ ID NO: 117 Protein sequence
Protein Accession #: Eos sequence

```
1          11         21         31         41         51
|          |          |          |          |          |
MVNQQDYGTR REHHGCRLEF CRVSAGCPCL SPLTSLVIVS SSAERGEEAA EEDFETSRGG   60
FMRMKERSHA HNIKVQGEAG GADEEAAASD PEDLAKIIDE DVKGIVQKKM RITVNQTKEM  120
QKRYFQLNIG NVKCHTLDEM IIRAQTWEIV MLLDQVPGPD PTQQVDGWIY LDNGAFQTEA  180
KHKPTDVKYK ETEPVCLFTI DIRVRTAQHT RIKQKVSITS MATPFPNSFK CFTCENAGDN  240
YNCNRWAEDK WCPQNTQYCL TVHHFTSHGR STSITKKCAS RSECHFVGCN HSRDSEHTEC  300
RSCCEGMICN VELPTNHTNA VFAVMHAQRT SGSSAPTLYL PVLAWVFVLP LL
```

SEQ ID NO: 118 DNA sequence
Nucleic Acid Accession #: XM_038659.6
Coding sequence: 528-1688

```
1          11         21         31         41         51
|          |          |          |          |          |
AGTAGGGAGG TGGGCAGGAG CCAGTGATGA CGGAATGGCA ATCACATTTG ACCTCTGATC   60
TGTTTATTTC CTCCTCCTTG ACGTCTCCAT ATAAATGTTA CACGGGCATC CCACACACTCG  120
GATACGCACC CACAGTGGCT GATTCGGGGG TAACCGTGTC ATTTGCTTGC AACACTGGCA  180
CCTCTGCCCT GCACCCCGGG AGTGAGCAGT GAGTGAGGCT CGGGTCTGGG CGCTGGCTCC  240
GAATCTTCGG GCTGGGAGAG ACTCCACCAT CTGGGGCGG CCTGGGGGAG CAGCCTTAGT  300
GTCTTCCTGC TGATGCAATC CGCTAGGTCG CGAGTCTCCG CCGCGAGAGG GCCGGTCTGC  360
AATCCAGCCC GCCACGTGTA CTCGCCGCCG CCTCGGGCAC TGCCCCAGGT CTTGCTGCAG  420
CCGGGACCGC GCTCTGCAGC CGCAGACCCG GTCCACACGG CCAGGGGCTA CGACCCTTGG  480
GATCTGCCCT CCGCTCAGCT CGAGCTTCCC TCGTGGCCGA CGGAACAATG AAGGATTGCA  540
```

TABLE 20-continued

```
GTAACGGATG CTCCGCAGAG TGTACCGGAG AAGGAGGATC AAAAGAGGTG GTGGGGACTT    600
TTAAGGCTAA AGACCTAATA GTCACACCAG CTACCATTTT AAAGGAAAAA CCAGACCCCA    660
ATAATCTGGT TTTTGGAACT GTGTTCACGG ATCATATGCT GACGGTGGAG TGGTCCTCAG    720
AGTTTGGATG GGAGAAACCT CATATCAAGC CTCTTCAGAA CCTGTCATTG CACCCTGGCT    780
CATCAGCTTT GCACTATGCA GTGGAATTAT TTGAAGGATT GAAGGCATTT CGAGGAGTAG    840
ATAATAAAAT TCGACTGTTT CAGCCAAACC TCAACATGGA TAGAATGTAT CGCTCTGCTG    900
TGAGGGCAAC TCTGCCGGTA TTTGACAAAG AAGAGCTCTT AGAGTGTATT CAACAGCTTG    960
TGAAATTGGA TCAAGAATGG GTCCCATATT CAACATCTGC TAGTCTGTAT ATTCGTCCTA   1020
CATTCATTGG AACTGAGCCT TCTCTTGGAG TCAAGAAGCC TACCAAAGCC CTGCTCTTTG   1080
TACTCTTGAG CCCAGTGGGA CCTTATTTTT CAAGTGGAAC CTTTAATCCA GTGTCCCTGT   1140
GGGCCAATCC CAAGTATGTA AGAGCCTGGA AAGGTGGAAC TGGGGACTGC AAGATGGGAG   1200
GGAATTACGG CTCATCTCTT TTTGCCCAAT GTGAAGCAGT AGATAATGGG TGTCAGCAGG   1260
TCCTGTGGCT CTATGGAGAG GACCATCAGA TCACTGAAGT GGGAACTATG AATCTTTTTC   1320
TTTACTGGAT AAATGAAGAT GGAGAAGAAG AACTGGCAAC TCCTCCACTA GATGGCATCA   1380
TTCTTCCAGG AGTGACAAGG CGGTGCATTC TGGACCTGGC ACATGACTGG GGTGAATTTA   1440
AGGTGTCAGA GAGATACCTC ACCATGGATG ACTTGACAAC AGCCCTGGAG GGAACAGAG    1500
TGAGAGAGAT GTTTGGCTCT GGTACAGCCT GTGTTGTTTG CCCAGTTTCT GATATACTGT   1560
ACAAAGGCGA GACAATACAC ATTCCAACTA TGGAGAATGG TCCTAAGCTG CAAGCCGCA    1620
TCTTGACCAA ATTAACTGAT ATCCAGTATG GAAGAGAAGA GAGCGACTGG ACAATTGTGC   1680
TATCCTGAAT GGAAAATAGA GGATACAATG GAAAATAGAG GATACCAACT GTATGCTACT   1740
GGGACAGACT GTTGCATTTG AATTGTGATA GATTTCTTTG GCTACCTGTG CATAATGTAG   1800
TTTGTAGTAT CAATGTCTTA CAAGAGTGAT TGTTTCTTCA TGCCAGAGAA AATGAATTGC   1860
AATCATCAAA TGGTGTTTCA TAACTTGGTA GTAGTAACTT ACCTTACCTT ACCTAGAAAA   1920
ACATTAATGT AAGCCATATA ACATGGGATT TTCCTCAATG ATTTTAGTGC CTCCTTTTGT   1980
ACTTCACTCA GATACTAAAT AGTAGTTTAT TCTTTAATAT AAGTTACATT CTGCTCCTCA   2040
AACAAATGCA ATTTTTTGTC TGTGTTTGAA AGCTAATTTC AGAAAATTTC ATAGGTTACA   2100
TTTCCTGCAG CCTATCTTTA TCCACAGAAA GTGTTTTCTT TTTTTTAAAT CAAGACTTTT   2160
AAAACTGGAT TTCCTCCCAT CACTGTTTTT TGAAGGTCCT CCAAGTCCGT GTTAAGGTAA   2220
ATATCTGTTT TCTTCCTGAT GTCACAGCCT GAGCATACTC TGTGCATTAG GAAGACCTGA   2280
GTGCATTTCC CACCATTGTC CTTTCCACAT TATGTTGTAG CTGGCTGGCT GTGAGGGGAC   2340
TACAAGACTG AGGGTCTTGT GGGTTATAGA TCTTTGTATC CCCCATGGCT GACATATAGT   2400
AGGTACTCAG TAAATGGTTT TATAATGAAT CAGTGAACAT TTTGCTTCTA TAGAAGTGTA   2460
CCTTCTTTGT TTCTATATTA TGAAACCTCT TTATTAGAAT TTGTGATTGA TTCTGACAGT   2520
GTATAGATTT ACCTTATATT GTCTTTATTT TCCATGAGCT ACTAAGTCAT TAGAGATACT   2580
CTGAAGCATA GTTAGTTTAG GAAATCACTT CATATTGATT GTATTAGAAT TATCTTGGAA   2640
TTGAAGATAT ATCCCTAGAG CAGGGGACCC CAACCCCCAG GCCATGGGCC ACACAGCAGG   2700
AAGAGGTGAG TGGTGGGCCA TTGAGGAGCT TCATCTGTAT TTATGGCTAC TTCCCATCAC   2760
TCGAATTACC ACCTGAACTC CACCTCTTGT CAGCTCAGTG GCACCATTAG ATTCTCATAG   2820
GAGCACAAAT CCTATTGTGA ACTCTGCATG CAAGGGATCT AGGCTATGCG CTCCTTATGA   2880
GAATCTAATG CTTGATGACC TGAGGTGTAA CAGTTTCATC CTGAAACCAC CCTTCACCCT   2940
```

TABLE 20-continued

```
GCAGTCTGTG GAAAAATTGT CTTCCACAAA ACTGGTCCCT GGTGCCAAAA ATGTTGGGGA   3000

CCACTGCTCT AGAGAGAGGT CATGATATCA TACCAACCAA ATGGAAATGA CAAATGTTTT   3060

ATGTCAAGTG TTAATTGCAG AAATAAATCT TTTTTTTTTT TTTTTGGTAG AAAACAAAGA   3120

GGCATACTCT GATTTTTATA CTCTGTTTTT GCAGGTGCTC TTTTCTTTGA ATGGAGATTT   3180

GATGAGCAAG TGGTTAGGAT GCAGGGAGAG CTACTATGGG TGATATTTTC CTTGTTTAGG   3240

AGCTGTGAGT TAAAATTGTA TCCTTTGTGG TTTATCTAAG GAAAGTCAAA TCTTGACAGA   3300

AAACATTTTT CCTTGGAAGG TCAACTCTCA GACATTGTAT TTTGGTTTCC CTCAGTCCTC   3360

ATAACTTCCT TCTTGCTGAA CATATTTTAT TCTCTTTTCA GAGAAGGAAA ATAAAAAGGA   3420

TTCTAAAAGT TTGATGCATT GGAAAAATTT CCTTGAGGCA TTTAGCAACA CATAGAAAAT   3480

GGGCTTTGAT TCTTTTCCAA AACTTTTAGC CATAGGGTCT TTTATAGACA GGGATAGTAA   3540

AATGAAAATT GAGAAATATA AGATGAAAAG GAATGATAAA AATATCTTTT AGGGGGCTTT   3600

TAATTGGTGA TCTGAAATCT TGGGAGAAGC TGTTCTTTTC AGGCCTGAGG TGCTCTTGAC   3660

TGTCGCCTGC GCACTGTGTA CCCCGAGCAA CATTCTAAGG GTGTGCTTTC GCCTTGGCTA   3720

ACTCCTTTGA CCTCATTCTT CATATAGTAG TCTAGGAAAA AGTTGCAGGT AATTTAAACT   3780

GTCTAGTGGT ACATAGTAAC TAAATTTCTA TTCCTATGAG AAATGAGAAT TATTTATTTG   3840

CCATCAACAC ATTTTATACT TTGCATCTCC AAATTTATTG TGGCGAGACT TGTCCATTGT   3900

GAAAGTTAGA GAACATTATG TTTGTATCAT TTCTTTCATA AAACCTCAAG AGCATTTTTA   3960

AGCCCTTTTC ATCAGACCCA GTGAAAACTA AGGATAGATG TTTAAAAACT GGAGGTCTCC   4020

TGATAAGGAG AACACAATCC ACCATTGTCA TTTAAGTAAT AAGACAGGAA ATTGACCTTG   4080

ACGCTTTCTT GTTAAATAGA TTTAACAGGA ACATCTGCAC ATCTTTTTTC CTTGTGCACT   4140

ATTTGTTTAA TTGCAGTGGA TTAATACAGC AAGAGTGCCA CATTATAACT AGGCAATTAT   4200

CCATTCTTCA AGACTTAGTT ATTGTCACAC TAATTGATCG TTTAAGGCAT AAGATGGTCT   4260

AGCATTAGGA ACATGTGAAG CTAATCTGCT CAAAAAGATC AACAAATTAA TATTGTTGCT   4320

GATATTTGCA TAATTGGCTG CAATTATTTA ATGTTTAATT GGGTTGATCA AATGAGATTC   4380

AGCAATTCAC AAGTGCATTA ATATAAACAG AACTGGTGGC ACTTAAAATG ATAATGATTA   4440

ACTTATATTG CATGTTCTCT TCCTTTCACT TTTTTCAGTT TCTACATTTC AGACCGAGCT   4500

TGTCAGCTTT TTTGAAAACA CATCAGTAGA AACCAAGATT TTAAAATGAA GTGTCAAGAC   4560

AAAGGCAAAA CCTGAGCAGT TCCTAAAAAG ATTTGCTGTT AGAAATTTTC TTTGTGGCAG   4620

TCATTTATTA AGGATTCAAC TCGTGATACA CCAAAAGAAG AGTTGACTTC AGAGATGTGT   4680

TCCATGCTCT CTAGCACAGG AATGAATAAA TTTATAACAC CTGCTTTAGC CTTTGTTTTC   4740

AAAAGCACAA AGGAAAGTG AAAGGGAAAG AGAAACAAGT GACTGAGAAG TCTTGTTAAG    4800

GAATCAGGTT TTTTCTACCT GGTAAACATT CTCTATTCTT TTCTCAAAAG ATTGCTGTAA   4860

GAAAAAATGT AAGAC

SEQ ID NO: 119 Protein sequence
Protein Accession #: XP_038659.2
1           11          21          31          41          51
|           |           |           |           |           |
MKDCSNGCSA  ECTGEGGSKE  VVGTFKAKDL  IVTPATILKE  KPDPNNLVFG  TVFTDHNLTV   60

EWSSEFGWEK  PHIKPLQNLS  LHPGSSALHY  AVELFEGLKA  FRGVDNKIRL  FQPNLNMDRM  120

YRSAVRATLP  VFDKEELLEC  IQQLVKLDQE  WVPYSTSASL  YIRPTFIGTE  PSLGVKKPTK  180

ALLFVLLSPV  GPYFSSGTFN  PVSLWANPKY  VRAWKGGTGD  CKMGGNYGSS  LFAQCEAVDN  240

GCQQVLWLYG  EDHQITEVGT  MNLFLYWINE  DGEEELATPP  LDGIILPGVT  RRCILDLAHQ  300
```

TABLE 20-continued

WGEFKVSERY LTMDDLTTAL EGNRVREMPG SGTACVVCPV SDILYKGETI HIPTMENGPK  360

LASRILGKLT DIQYGREESD WTIVLS

SEQ ID NO: 120 DNA sequence
Nucleic Acid Accession #: NM_005377
Coding sequence: 121..1194

```
1          11         21         31         41         51
|          |          |          |          |          |
ACAGAGGGCG GGTCGCGCGC TCGGTGGCCG TTGTGCGCGT GTGTGGAGTG CCCTGCTGCC   60
CCCAGCTGGA GGGGAACTAG TCTGCTCCAG GTGGCAAGCT GCGTGAGCAA GCAAGCCAAC  120
ATGGACCGCG ACTCGTACCA TCACTATTTC TACGACTATG ACGGCGGGGA GGATTTCTAC  180
CGCTCCACGA CGCCCAGCGA GGACATCTGG AAGAAATTCG AGTTGGTGCC GCCGCCCTGG  240
ACTTGGGTCC GCAGCCGGGA ACCCAGCCCT CAGCTTTGGT CTCCTGGAAC GTGGCCGGTA  300
GGGTGCGCTG GGGACGAGAC GGAATCCCAG GACTACTGGA AAGCTTGGGA CGCGAACTAC  360
GCCTCCCTCA TCCGCCGTGA CTGCATGTGG AGCGGCTTCT CCACCCAGGA GCCGCTGGAG  420
AGAGCGGTGA GTGACCTGCT TGCCGTTGGC GCGCCCTCGG GATACTCGCC CAAGGAGTTC  480
GCCACCCCCG ACTACACTCC CGAGCTCGAA GCCGGCAACC TAGCGCCCAT CTTCCCCTGT  540
TTGTTGGGCG AGCCCAAGAT CCAGGCCTGC TCCAGGTCTG AGAGCCCAAG CGACTCCGAG  600
GGTGAAGAAA TCGACGTGAC AGTAAAGAAG AGGCAGTCTT TGAGTACGCG GAAGCCAGTC  660
ATCATCGCGG TGCGTGCAGA CCTTCTGGAT CCCCGCATGA ATCTCTTCCA CATCTCCATC  720
CACCAGCAAC AGCACAACTA TGCTGCCCCT TTTCCTCCAG AAAGCTGCTT CCAAGAAGGG  780
GCTCCAAAGA GGATGCCCCC AAAAGAGGCT CTAGAGAGAA AGCTCCAGG GGGAAAGGAT  840
GATAAGGAAG ATGAAGAGAT TGTGAGCCTC CCACCTGTAG AAAGTGAGGC TGCCCAGTCC  900
TGCCAGCCCA AACCCATCCA TTATGATACT GAGAATTGGA CCAAGAAGAA GTACCACAGC  960
TACCTGGAGC GCAAGAGACG GAATGATCAA CGTTCGCGGT TCTTGGCCCT GAGGGACGAG 1020
GTACCCGCCC TGGCCAGCTG CTCTAGGGTT TCCAAAGTAA TGATCCTAGT CAAGGCCACG 1080
GAATACTTAC ATGAACTGGC GGAAGCCGAG GAGAGGATGG CTACGGAGAA AAGGCAGCTC 1140
GAATGCCAGC GACGGCAATT GCAGAAAAGA ATTGAGTACC TCAGTAGCTA CTGACCAAAA 1200
AGCCTGACCA TTCTGTCTTA AAAAGACACA AGTTTTCTTT TTGATCTCCC TCTCCCCTTT 1260
AGTAACTTGT ACATTTTTGT TACACCAGGA CACTCTGGAC AGTAGATTGC AGAATCGATT 1320
GCAGCCAGTG CACAAACAAT ATAAAGGCTT GCATTCTTGG AAACTTTGAA ACCCAGCTCT 1380
CTCTCTTCCC TGACTTATGG GAGTGCTTTG TGTTTTCTGG CACCTTTGGC TTCTCAGCAG 1440
GCAGCTGACT GAGGAGACTT GGGGTCTTCC TGGCTCACTA TCTCCAAAGA AAAGGCTGAC 1500
AGATGGTATG CAACAGGTGG TGGATGTTGT TGGGGCTCC AGCCTGGAGG AAATCTCACA 1560
CTCTACATGA ACTTTAGGCT AGGAAAGGAT GTCTCTGGGG TGATGCAAGG ACAGCTGGGT 1620
GTGGACGCTC TCCTGCGGCT CCATTTTTTT CCAGGAGACA CACAAGCTGC CTTGGGTGAA 1680
AACAAGCTCA GAGACTTGAT CAACGTGGAC CATTACCTCA CTGTCAGACA CTACAGCTAG 1740
CTGAGGAGTT GGAAACCTTA CATATATGTA TATATATATG TATGTATATA TGTATATATG 1800
TATATATATA TGTATGTATA TATGTATATA TGTATATATA TATGTATGTA TATATGTATA 1660
TATGTATATA TATATGTATG TATATATGTA TATATTATGA TGTTGGCTGA CCCCCTTCCT 1920
CCCACTCTCA ATGCTGTGAC TCAGAACATT TAAGAGAACT TCGTCTGTAA GTAATTTGTC 1980
TTAAAGCCCT CTGGGCTCTC TTCTCTGAGT GAGGGAACTT TCTGTCTTCA CAAGGGACTT 2040
TGTCTCATTC TGCCTCTGTT ATGCAATGGG TTCTACAGCA CCCTTTCCCG CAGGTTAGAA 2100
```

TABLE 20-continued

```
ATATTTCCCT AAGACACAGG GAAATGGGTC TTAGCCTGGG GCCTGGGGAA AGTTCCCAAG  2160

CCCTGGCTCA TGAACTCAAT CCCTGCCCAG GTGTTTTCTG AGGGGCCCTT GAGGCCAATC  2220

TTTTCTCAAG ACAGTGTGAG GCACCTTAGA AGGGAGAACT GTAACACTTT CTCTTTCGCA  2280

CCTGCCTCTC ATCTCAATCC TTGACTGATG AATTTGAAGT TCTACTAGAA CCATGAAAAC  2340

TTGTTCCTTT CGTGCATCTC CAAGGAGCTT GCTGGCTCTG CAGCCACGCT TGGGCCCTCG  2400

CACCAGCCTG CAATGAATCA GATGTCTGTC ACAGAATCTG GCCTCTCTG AAGTTTTCTG  2460

GAGAGCTGTT GGGACTCATC CAGTGCTCCA CAACGTGGAC TTGCCTCCTG GTGTGTTTTA  2520

AAGGATCCTC CAGGAGCTCT GCTTAGCCAA TCATCATGAT GGATTTTTTT TTTTTTTTT  2580

GAGACGGAGT CTCAACTCTT GTCGCCCAGG CTGGAGGTTA ATGGCATGAT CTCGGCTCAC  2640

TGCAACCTCT GCCTCCCGGG TTCAAGCGAT TCTCCTGCCT GAGCCTTCCG AGTAGCTGGG  2700

ATCGCAGGCG CCTGCCACCA CGCCTAGCTA ATTTCTGTAT TTTTAGTAGA GATGGGGTTT  2760

CACCACATTG GCCAGGCTGG TCTTGACCTC CTGACCTAGG TGATCCACTG CCTCCATGAT  2620

AGATTTTGCC CCAGCTGGAC TCTGCAGCTC ACGTGGAATT CCAGGTGCCT GCCTCCAGTC  2880

TGGGAAAGTC ACCAACCCGC AGCTTGTCAT GTGGGTAACT TCTGAACCCT AAGCC

SEQ ID NO: 121 Protein sequence
Protein Accession #: NP_005368
1          11         21         31         41         51
|          |          |          |          |          |
MDRDSYHHYF YDYGGGEDFY RSTTPSEDIW KKFELVPPPW TWVRSREPSP QLWSPGTWPV  60

GCAGDETESQ DYWKAWDANY ASLIRRDCMW SGFSTQEPLE RAVSDLLAVG APSGYSPKEF  120

ATPDYTPELE AGNLAPIFPC LLGEPKIQAC SRSESPSDSE GEEIDVTVKK RQSLSTRKPV  180

IIAVRADLLD PRMNLFHISI HQQQHNYAAP FPPESCFQEG APKRMPPKEA LEREAPGGKD  240

DKEDEEIVSL PPVESEAAQS CQPKPIHYDT ENWTKKKYNS YLERKRRNDQ RSRFLALRDE  300

VPALASCSRV SKVMILVKAT EYLHELAEAE ERMATEKRQL ECQRRQLQKR IEYLSSY

SEQ ID NO: 122 DNA sequence
Nucleic Acid Accession #: AB006625.2
Coding sequence: 356..4750
1          11         21         31         41         51
|          |          |          |          |          |
GAGGTTTGGG AGGCGCGGGA GATGTCCACC CTGGGCTGGT GGCGCCGCCG GGCGCCGGGC  60

GCCATGAGGG TGCGCTAGGC GGCTGTTCGT GCCCGAGGCT GCGCAGCACT GAGGTGAGCT  120

TTGCCTTCTT GATCTTCCGT CCTTCTTGGA GACGACTGGC GAGAGGAAGA GGGACTAGGT  180

CCAAACGCTA GGTGGCTGGG TCCAGCCGGA GACCCGCACC AAGGAGGAGA TCATCGAGCT  240

CTTGGTCCTT GAGCAGTACC TGACCATCAT CCCTGAAAAG CTCAAGCCTT GGGTGCGAGC  300

AAAAAAGCCG GAGAACTGTG AGAAGCTCGT CACTCTGCTG GAGAATTACA AGGAGATGTA  360

CCAACCAGAA GACGACAACA ACAGTGACGT GACCAGCGAC GACGACATGA CCCGGAACAG  420

AAGAGAGTCC TCACCACCTC ACTCAGTCCA TTCTTTCAGT GGTGACCGGG ACTGGGACCG  480

GAGGGGCAGA AGCAGAGACA TGGAGCCACG AGACCGCTGG TCCACACCA GGAACCCAAG  540

AAGCAGGATG CCTCCGCGGG ATCTTTCCCT TCCTGTGGTG GCGAAAACAA GCTTTGAAAT  600

GGACAGAGAG GACGACAGGG ACTCCAGGGC TTATGAGTCC CGATCTCAGG ATGCTGAATC  660

ATACCAAAAT GTGGTGGACC TCGCTGAGGA CAGGAAACCT CACAACACAA TCCAGGACAA  720

CATGGAAAAC TACAGGAAGC TGCTCTCCCT CGGAGTGCAG CTTGCTGAAG ACGATGGCCA  780

CTCCCACATG ACGCAGGGCC ACTCATCAAG ATCAAGAGA AGTGCCTACC CAAGCACCAG  840

TCGAGGTCTA AAAACTATGC CTGAAGCCAA AAAATCAACC CACCGGCGGG CGATTTCTGA  900
```

TABLE 20-continued

```
AGATGAATCT TCCCACGGAG TGATAATGGA AAAATTCATC AAGGATGTGT CACGCAGTTC    960
CAAATCGGGA AGAGCAAGGG AGTCAAGCGA CCGGTCACAG AGATTCCCCA GAATGTCAGA   1020
TGATAACTGG AAGGACATTT CATTGAACAA GAGGGAGTCA GTGATCCAGC AGCGGGTTTA   1080
TGAAGGGAAT GCATTTAGGG GAGGCTTTAG GTTTAATTCA ACCCTTGTTT CCAGAAAGAG   1140
AGTTCTTGAA AGAAAGAGGC GCTATCATTT TGACACACAT GGGAAGGGCT CGATTCACGA   1200
TCAAAAAGGC TGTCCCAGGA AGAAGCCCTT TGAATGTGGT AGTGAGATGA GAAAACCCAT   1260
GAGCGTGAGC AGCCTGAGCA GCCTGAGCTC CCCCTCCTTT ACCGAGTCAC AGCCAATTGA   1320
TTTTGGGGCA ATGCCATATG TATGTGATGA GTGTGGGAGG TCGTTCAGTG TCATCTCAGA   1380
ATTTGTTGAG CACCAGATCA TGCATACTAG AGAGAACCTC TATGAGTATG GTGAGTCCTT   1440
TATCCACAGT GTGGCTGTCA GTGAAGTTCA GAAAAGTCAG GTTGGAGGGA AACGTTTTGA   1500
ATGTAAGGAC TGTGGAGAGA CCTTCAATAA GAGTGCCGCC TTGGCTGAAC ATCGGAAGAT   1560
TCATGCTAGA GGTTATCTTG TGGAATGTAA GAATCAGGAA TGTGAGGAAG CCTTCATGCC   1620
TAGCCCCACC TTTAGTGAGC TTCAGAAAAT ATATGCCAAA GACAAATTCT ACGAGTGCAG   1680
GGTGTGTAAG GAAACCTTCC TTCATAGTTC TGCCCTGATT GAGCACCAGA AAATCCACTT   1740
TGGGGATGAC AAAGATAATG AGCGTGAACA TGAACGTGAA CGTGAACGTG AGCGCGGGGA   1800
AACCTTTAGG CCCAGCCCAG CCCTTAATGA GTTTCAGAAA ATGTATGGTA AGAGAAAAT   1860
GTACGAATGT AAGGTGTGTG GCACACTTT CCTTCATAGC TCATCCCTGA AGAACATCA   1920
GAAAATCCAT ACTAGAGGGA ACCCATTTGA AAACAAGGGT AAAGTGTGTG AGGAAACCTT   1980
TATTCCTGGT CAGTCCCTTA AAAGGCGTCA GAAAACTTAC AATAAGGAGA AGCTCTGTGA   2040
CTTTACAGAT GGCCGGGATG CCTTCATGCA AAGCTCAGAG CTCAGTGAGC ATCAGAAAAT   2100
TCATTCTCGA AAGAACCTCT TTGAAGGCAG AGGGTATGAG AAATCTGTCA TTCATAGTGG   2160
GCCATTCACT GAATCTCAGA AGAGTCATAC TATAACAAGA CCTCTTGAAA GTGATGAGGA   2220
CGAAAAGGCG TTCACCATTA GCTCTAACCC CTATGAAAAC CAGAAGATTC CCACTAAGGA   2280
AAATGTCTAC GAGGCAAAAT CATATGAGAG GTCTGTTATT CATAGCTTAG CCTCTGTGGA   2340
AGCTCAGAAA AGTCACAGTG TAGCAGGGCC CAGTAAACCA AAAGTAATGG CAGAGTCTAC   2400
CATTCAGAGC TTCGATGCTA TCAACCATCA GAGAGTTCGT GCTGGAGGGA ACACCTCTGA   2460
AGGAAGGGAA TACAGTAGGT CTGTTATCCA TAGCTTAGTG GCTTCCAAAC CTCCAAGAAG   2520
TCACAATGGA AATGAATTGG TGGAATCTAA TGAGAAGGGA GAATCCTCCA TTTATATCTC   2580
AGACCTTAAT GATAAGCGAC AGAAGATTCC TGCCAGAGAG AACCCTTGTG AAGGGGGCAC   2640
TAAGAATCGC AACTATGAAG ACTCTGTCAT ACAGAGTGTA TTCCGTGCCA AACCTCAGAA   2700
AAGTGTTCCT GGAGAGGGAT CTGGTGAGTT TAAGAAGGAT GGCGAATTCT CTGTTCCCAG   2760
CTCAAATGTC CGTGAATACC AGAACGCTCG TGCTAAAAAG AAATACATTG AGCATAGGAG   2820
CAATGAGACC TCTGTAATTC ACTCTCTGCC TTTTGGTGAA CAAACATTTC GCCCTCGAGG   2860
GATGCTCTAT GAATGTCAGG AGTGTGGGGA GTGCTTTGCT CATAGCTCTG ACCTCACTGA   2940
GCACCAGAAG ATTCATGATA GGGAGAAGCC CTCTGGAAGC AGAAACTATG AATGGTCTGT   3000
CATTCGCAGC TTGGCCCCTA CTGACCCTCA AACAAGTTAC GCCCAAGAGC AGTATGCTAA   3060
AGAGCAAGCG CGGAACAAAT GTAAGGACTT CAGACAATTT TTTGCTACCA GCGAAGACCT   3120
CAACACAAAC CAGAAAATCT ATGACCAAGA GAAGTCTCAT GGCCAGGACT CTCAAGGCGA   3180
GAATACTGAT GGGGAGGAGA CCCACAGCGA GGAGACCCAT GGTCAGGAGA CAATTGAAGA   3240
CCCTGTCATT CAAGGCTCAG ACATGGAAGA CCCTCAGAAG GATGACCCTG ATGACAAAAT   3300
```

TABLE 20-continued

```
CTATGAATGT GAGGACTGTG GCCTGGGCTT TGTGGATCTC ACAGACCTCA CAGACCATCA  3360

GAAAGTCCAC AGCAGGAAGT GCCTGGTTGA CAGTCGGGAG TACACACATT CTGTAATTCA  3420

CACCCATTCC ATCAGCGAGT ATCAGAGAGA TTACACTGGA GAGCAGCTGT ATGAATGTCC  3480

AAAGTGTGGG GAATCTTTTA TTCATAGCTC ATTCCTTTTC GAGCATCAGA GAATCCATGA  3540

ACAAGACCAG TTGTATTCCA TGAAGGGGTG TGATGATGGT TTTATTGCCC TCTTGCCCAT  3600

GAAGCCACGG AGGAATCGTG CTGCAGAGAG GAATCCTGCT CTTGCTGGGT CGGCCATTCG  3660

ATGCCTTTTG TGTGGACAAG GCTTCATTCA TAGCTCTGCC CTTAATGAGC ATATGAGACT  3720

TCATAGGGAA GATGATTTAC TGGAGCAGAG CCAGATGGCT GAGGAAGCTA TCATTCCAGG  3780

CTTAGCCCTC ACTGAGTTTC AGAGAAGTCA GACCGAAGAG AGACTCTTTG AATGTGCAGT  3840

CTGTGGAGAA TCTTTCGTCA ACCCAGCAGA ACTTGCAGAT CACGTAACTG TTCATAAGAA  3900

TGAGCCCTAT GAGTACGGGT CCTCCTATAC TCACACCTCA TTTCTTACTG AGCCCCTCAA  3960

AGGAGCTATA CCATTCTATG AATGCAAGGA TTGTGGTAAG TCCTTTATTC ATAGCACAGT  4020

CCTCACTAAA CATAAGGAGC TTCATCTGGA AGAAGAAGAA GAAGATGAAG CAGCAGCAGC  4080

TGCAGCAGCA GCAGCCCAGG AAGTTGAAGC CAATGTCCAT GTTCCACAAG TAGTTCTGAG  4140

GATTCAGGGC TTAAACGTAG AGGCTGCTGA GCCAGAAGTG GAGGCTGCCG AGCCAGAAGT  4200

GGAGGCTGCT GAGCCAGAAG TGGAGGCTGC TGAGCCAAAC GGAGAGGCTG AAGGGCCAGA  4260

TGGAGAGGCT GCAGAGCCCA TTGGAGAGGC TGGACAGCCA AATGGAGAGG CCGAGCAGCC  4320

AAATGGGGAT GCTGATGAGC CAGATGGTGC AGGTATTGAA GACCCAGAAG AAAGAGCTGA  4380

AGAGCCAGAG GGAAAAGCTG AAGAGCCAGA GGGAGATGCC GACGAGCCTG ACGGTGTGGG  4440

AATTGAAGAC CCAGAAGAAG GTGAAGATCA AGAGATTCAG GTAGAAGAAC CATACTATGA  4500

CTGCCATGAA TGCACAGAAA CCTTCACTTC CAGCACAGCA TTCAGTGAAC ACCTGAAAAC  4560

TCATGCCAGC ATGATCATAT TTGAGCCTGC AAATGCCTTT GGGGAGTGCT CAGGCTACAT  4620

CGAACGTGCC AGCACCAGCA CAGGTGGTGC CAATCAAGCT GATGAGAAGT ACTTCAAATG  4680

TGACGTCTGT GGGCAGCTCT TCAATGACCG CCTGTCCCTC GCCAGACACC AGAATACCCA  4740

CACTGGCTGA GGGCATGGGG TAAAGGTTAG AAAACCTTCA CCTAGGACTT GACCCTTACC  4800

AAACCACAGA GAATCCAAAC CAATCCATGA TAATGTCAGT AGGAGACTTA ACCTTAGTGT  4860

GTTACACACC TGACTTAACA TCTCTAAACT CAGATTGAAA AGAGACCGAA TGTGCAGATT  4920

CCACAGTCTT AAGCTTTCCC CTTCAGATGT CAGTGTCTGC ATGTGGGAAA GCCATAGCAC  4980

ACATCTTACC TTTCCAAGTA ATCAGATTGA GAAAACCCTA TGAGTATTCC AGACTACAGA  5040

GTTTGCCCAA ATCAACTGTA AATGACACTT GTGTAACGTA TATATAGTGT TTCATGAGGT  5100

GTATATAAAA TAGCAAATTA TGACAGAACA GTGATCACAT ATATTTGGAT TTATATGATA  5160

TACAGTTACA GTTTACTCTG CAGAGGTACC TTACCTGGTA TTCTTTGAAT TTTTTTTTTT  5220

TTTGGAGGAG GAAGAGAGCA ACAAATTTGA TTATATTTTT AAGTGTCTTA GATCCTGAGA  5280

AAGATTTATT GTGCATTATT TGAACCCTGT CAATATCTTT TTGAGTAATT GTTTTGTTTC  5340

TTACCCTTAA ATAGTCTTGT GAAGCTGTAG GCATGATAGA TAACATGGCT TTTACTCCTT  5400

ACTGTTTGAA AAGATAAGTA CTTTAGCTTC TTTCTGCAGC CATTTCATCT GCACCAACAC  5460

TTTGAACCT AATACTGTGT AAGGCTTTAC AATATACGGA TTGGCTTTTT GTGACCCAGA  5520

TTGATTGGTT GCCACATGTT ATGTTTGTTG AAGTGGTTCT CATGCAAAAA TATTACACAT  5580

TTGTGTTCTG GGTTTTTTTT TTTTTTAAC CAACTCAATA TGTGTTTGAT GATAGTGAAT  5640

TGATAAAACC CGAAGCTTTT CCCTGTAAAT CTTACATCTT TGCCTTTAAA GAATGGGTTA  5700
```

TABLE 20-continued

```
CAACCATCAC TAGATCACAG TAGTGCCTAA TGAAGGTTGA GAACCGTAGG AGAGGCTCTC 5760

ATGCTGTAAA TAATGTTGCA GGCTAATAAC CTTTCATCAC TTCCTTTGTG CGCTTCCTGC 5820

CTTAAGTGAC AAGTAGCAAC ATGGCTTGGG TCCCCTGTGC AGCATCAGCT TATGCTGCCA 5880

CAAGTCAGTT TGCACCGTAG GTGCCCAGGA GCTAGTATCC TTAGATCTTT CTATCCCTAA 5940

CTTAATTCTC TTCGTTATTT ATCTGACCCT CTAACTCCAT GTCTAACTTG CATT

SEQ ID NO: 123 Protein sequence
Protein Accession #. BAA22956.2
1          11         21         31         41         51
|          |          |          |          |          |

VQTLGGWVQP ETRTKEEIIE LLVLEQYLTI IPEKLKPWVR AKKPENCEKL VTLLENYKEM  60

YQPEDDNNSD VTSDDDMTRN RRESSPPHSV HSFSGDRDWD RRGRSRDMEP RDRWSHTRNP 120

RSRMPPRDLS LPVVAKTSFE MDREDDRDSR AYESRSQDAE SYQNVVDLAE DRKPHNTIQD 180

NMENYRKLLS LGVQLAEDDG HSHMTQGHSS RSKRSAYPST SRGLKTMPEA KKSTHRRGIC 240

EDESSHGVIM EKFIKDVSRS SKSGRARESS DRSQRFPRMS DDNWKDISLN KRESVIQQRV 300

YEGNAFRGGF RFNSTLVSRK RVLERKRRYH FDTDGKGSIH DQKGCPRKKP FECGSEMRKA 360

MSVSSLSSLS SPSFTESQPI DFGAMPYVCD ECGRSFSVIS EFVEHQIMHT RENLYEYGES 420

FIHSVAVSEV QKSQVGGKRF ECKDCGETFN KSAALAEHRK IHARGYLVEC KNQECEEAFM 480

PSPTFSELQK IYGKDKFYEC RVCKETFLHS SALIEHQKIH FGDDKDNERE HERERERERG 540

ETFRPSPALN EFQKMYGKEK MYECKVCGET FLHSSSLKEH QKIHTRGNPF ENKGKVCEET 600

FIPGQSLKRR QKTYNKEKLC DFTDGRDAFM QSSELSEHQK IHSRKNLFEG RGYEKSVIHS 660

GPFTESQKSH TITRPLESDE DEKAFTISSN PYENQKIPTK ENVYEAKSYE RSVIHSLASV 720

EAQKSHSVAG PSKPKVMAES TIQSFDAINH QRVRAGGNTS EGREYSRSVI HSLVASKPPR 780

SHNGNELVES NEKGESSIYI SDLNDKRQKI PARENPCEGG SKNRNYEDSV IQSVFRAKPQ 840

KSVPGEGSGE FKKDGEFSVP SSNVREYQKA RAKKKYIENR SNETSVIHSL PFGEQTFRPR 900

GMLYECQECG ECFAHSSDLT EHQKIHDREK PSGSRNYEWS VIRSLAPTDP QTSYAQEQYA 960

KEQARNKCKD FRQFFATSED LNTNQKIYDQ EKSHGESEQG ENTDGEETHS EETHGQETIE 1020

DPVIQGSDME DPQKDDPDDK IYECEDCGLG FVDLTDLTDH QKVNSRKCLV DSREYTNSVI 1080

HTHSISEYQR DYTGEQLYEC PKCGESFIHS SFLFEHQRIH EQDQLYSMKG CDDGFIALLP 1140

MKPRRNRAAE RNPALAGSAI RCLLCGQGFI HSSALNEHMR LHREDDLLEQ SQMAEEAIIP 1200

GLALTEFQRS QTEERLFECA VCGESFVNPA ELADNVTVNK NEPYEYGSSY THTSFLTEPL 1260

KGAIPFYECK DCGKSFIHST VLTKHKELHL EEEEEDEAAA AAAAAAQEVE ANVHVPQVVL 1320

RIQGLNVEAA EPEVEAAEPE VEAAEPEVEA AEPNGEAEGP DGEAAEPIGE AGQPNGEAEQ 1380

PNGDADEPDG AGIEDPEERA EEPEGKAEEP EGDADEPDGV GIEDPEEGED QEIQVEEPYY 1440

DCHECTETFT SSTAFSEHLK THASMIIFEP ANAFGECSGY IERASTSTGG ANQADEKYFK 1500

CDVCGQLFND RLSLARHQNT HTG

SEQ ID NO: 124 DNA sequence
Nucleic Acid Accession #: NM_007196
Coding sequence: 180..1962
1          11         21         31         41         51
|          |          |          |          |          |

GTTCCCAGAA GCTCCCCAGG CTCTAGTGCA GGAGGAGAAG GAGGAGGAGC AGGAGGTGGA  60

GATTCCCAGT TAAAAGGCTC CAGAATCGTG TACCAGGCAG AGAACTGAAG TACTGGGGCC 120

TCCTCCACTG GGTCCGAATC AGTAGGTGAC CCCGCCCCTG GATTCTGGAA GACCTCACCA 180

TGGGACGCCC CCGACCTCGT GCGGCCAAGA CGTGGATGTT CCTGCTCTTG CTGGGGGGAG 240
```

TABLE 20-continued

```
CCTGGGCAGG ACACTCCAGG GCACAGGAGG ACAAGGTGCT GGGGGGTCAT GAGTGCCAAC  300
CCCATTCGCA GCCTTGGCAG GCGGCCTTGT TCCAGGGCCA GCAACTACTC TGTGGCGGTG  360
TCCTTGTAGG TGGCAACTGG GTCCTTACAG CTGCCCACTG TAAAAAACCG AAATACACAG  420
TACGCCTGGG AGACCACAGC CTACAGAATA AAGATGGCCC AGAGCAAGAA ATACCTGTGG  480
TTCAGTCCAT CCCACACCCC TGCTACAACA GCAGCGATGT GGAGGACCAC AACCATGATC  540
TGATGCTTCT TCAACTGCGT GACCAGGCAT CCCTGGGGTC AAAGTGAAG CCCATCAGCC   600
TGGCAGATCA TTGCACCCAG CCTGGCCAGA AGTGCACCGT CTCAGGCTGG GGCACTGTCA  660
CCAGTCCCCG AGAGAATTTT CCTGACACTC TCAACTGTGC AGAAGTAAAA ATCTTTCCCC  720
AGAAGAAGTG TGAGGATGCT TACCCGGGGC AGATCACAGA TGGCATGGTC TGTGCAGGCA  780
GCAGCAAAGG GGCTGACACG TGCCAGGGCG ATTCTGGAGG CCCCCTGGTG TGTGATGGTG  840
CACTCCAGGG CATCACATCC TGGGGCTCAG ACCCCTGTGG GAGGTCCGAC AAACCTGGCG  900
TCTATACCAA CATCTGCCGC TACCTGGACT GGATCAAGAA GATCATAGGC AGCAAGGGCT  960
GATTCTAGGA TAAGCACTAG ATCTCCCTTA ATAAACTCAC AACTCTC

SEQ ID NO: 125 Protein sequence
Protein Accession #: NP_009127
1         11        21        31        41        51
|         |         |         |         |         |
MGRPRPRAAK TWMFLLLLGG AWAGHSRAQE DKVLGGHECQ PHSQPWQAAL FQGQQLLCGG  60
VLVGGNWVLT AAHCKKPKYT VRLGDHSLQN KDGPEQEIPV VQSIPHPCYN SSDVEDHNHD 120
LMLLQLRDQA SLGSKVKPIS LADHCTQPGQ KCTVSGWGTV TSPRENFPDT LNCAEVKIFP 180
QKKCEDAYPG QITDGMVCAG SSKGADTCQG DSGGPLVCDG ALQGITSWGS DPCGRSDKPG 240
VYTNICRYLD WIKKIIGSKG SEQ ID NO: 126 DNA sequence
Nucleic Acid Accession #: NM_014791.1
Coding sequence: 171..2126
1         11        21        31        41        51
|         |         |         |         |         |
TTGGCGGGCG GAAGCGGCCA CAACCCGGCG ATCGAAAAGA TTCTTAGGAA CGCCGTACCA  60
GCCGCGTCTC TCAGGACAGC AGGCCCCTGT CCTTCTGTCG GGCGCCGCTC AGCCGTGCCC 120
TCCGCCCCTC AGGTTCTTTT TCTAATTCCA AATAAACTTG CAAGAGGACT ATGAAAGATT 180
ATGATGAACT TCTCAAATAT TATGAATTAC ATGAAACTAT GGGACAGGT GGCTTTGCAA 240
AGGTCAAACT TGCCTGCCAT ATCCTTACTG GAGAGATGGT AGCTATAAAA ATCATGGATA 300
AAAACACACT AGGGAGTGAT TGCCCCGGA TCAAAACGGA GATTGAGGCC TTGAAGAACC  360
TGAGACATCA GCATATATGT CAACTCTACC ATGTGCTAGA CAGCCAAC AAAATATTCA   420
TGGTTCTTGA GTACTGCCCT GGAGGAGAGC TGTTTGACTA TATAATTTCC CAGGATCGCC  480
TGTCAGAAGA GGAGACCCGG GTTGTCTTCC GTCAGATAGT ATCTGCTGTT GCTTATGTGC  540
ACAGCCAGGG CTATGCTCAC AGGGACCTCA AGCCAGAAAA TTTGCTGTTT GATGAATATC  600
ATAAATTAAA GCTGATTGAC TTTGGTCTCT GTGCAAAACC CAAGGGTAAC AAGGATTACC  660
ATCTACAGAC ATGCTGTGGG AGTCTGGCTT ATGCAGCACC TGAGTTAATA CAAGGCAAAT  720
CATATCTTGG ATCAGAGGCA GATGTTTGGA GCATGGCAT ACTGTTATAT GTTCTTATGT   780
GTGGATTTCT ACCATTTGAT GATGATAATG TAATGGCTTT ATACAAGAAG ATTATGAGAG  840
GAAAATATGA TGTTCCCAAG TGGCTCTCTC CAGTAGCAT TCTGCTTCTT CAACAAATGC    900
TGCAGGTGGA CCCAAAGAAA CGGATTTCTA TGAAAAATCT ATTGAACCAT CCCTGGATCA  960
TGCAAGATTA CAACTATCCT GTTGAGTGGC AAAGCAAGAA TCCTTTTATT CACCTCGATG 1020
```

TABLE 20-continued

```
ATGATTGCGT AACAGAACTT TCTGTACATC ACAGAAACAA CAGGCAAACA ATGGAGGATT  1080
TAATTTCACT GTGGCAGTAT GATCACCTCA CGGCTACCTA TCTTCTGCTT CTAGCCAAGA  1140
AGGCTCCCGG AAAACCAGTT CGTTTAACGC TTTCTTCTTT CTCCTGTGGA CAAGCCAGTG  1200
CTACCCCATT CACAGACATC AAGTCAAATA ATTGGAGTCT GGAAGATGTG ACCGCAAGTG  1260
ATAAAAATTA TGTGGCGGGA TTAATAGACT ATGATTGGTG TGAAGATGAT TTATCAACAG  1320
GTGCTGCTAC TCCCCGAACA TCACAGTTTA CCAAGTACTG GACAGAATCA AATGGGGTGG  1380
AATCTAAATC ATTAACTCCA GCCTTATGCA GAACACCTGC AAATAAATTA AGAACAAAG   1440
AAAATGTATA TACTCCTAAG TCTGCTGTAA AGAATGAAGA GTACTTTATG TTTCCTGAGC  1500
CAAAGACTCC AGTTAATAAG AACCAGCATA AGAGACAAAT ACTCACTACG CCAAATCGTT  1560
ACACTACACC CTCAAAAGCT AGAAACCAGT GCCTGAAAGA AACTCCAATT AAAATACCAG  1620
TAAATTCAAC AGGAACAGAC AAGTTAATGA CAGGTGTCAT TAGCCCTGAG AGGCGGTGCC  1680
GCTCAGTGGA ATTGGATCTC AACCAAGCAC ATATGGAGGA GACTCCAAAA AGAAAGGGAG  1740
CCAAAGTGTT TGGGAGCCTT GAAAGCGGGT TGGATAAGGT TATCACTGTG CTCACCAGGA  1800
GCAAAAGGAA GGGTTCTGCC AGAGACGGGC CCAGAAGACT AAAGCTTCAC TATAATGTGA  1860
CTACAACTAG ATTAGTGAAT CCAGATCAAC TGTTGAATGA ATAATGTCT  ATTCTTCCAA  1920
AGAAGCATGT TGACTTTGTA CAAAAGGGTT ATACACTGAA GTGTCAAACA CAGTCAGATT  1980
TTGGGAAAGT GACAATGCAA TTTGAATTAG AAGTGTGCCA GCTTCAAAAA CCCGATCTGG  2040
TGGGTATCAG GAGGCAGCGG CTTAAGGGCG ATGCCTGGGT TTACAAAAGA TTAGTGGAAG  2100
ACATCCTATC TAGCTGCAAG GTATAATTGA TGGATTCTTC CATCCTGCCG GATGAGTGTG  2160
GGTGTGATAC AGCCTACATA AAGACTGTTA TGATCGCTTT GATTTTAAAG TTCATTGGAA  2220
CTACCAACTT GTTTCTAAAG AGCTATCTTA AGACCAATAT CTCTTTGTTT TTAAACAAAA  2280
GATATTATTT TGTGTATGAA TCTAAATCAA GCCCATCTGT CATTATGTTA CTGTCTTTTT  2340
TAATCATGTG GTTTTGTATA TTAATAATTG TTGACTTTCT TAGATTCACT TCCATATGTG  2400
AATGTAAGCT CTTAACTATG TCTCTTTGTA ATGTGTAATT TCTTTCTGAA ATAAAACCAT  2460
TTGTGAATAT
```

SEQ ID NO. 127 Protein sequence
Protein Accession #: NP_055606.1

```
1          11         21         31         41         51
|          |          |          |          |          |
MKDYDELLKY YELHETIGTG GFAKVKLACH ILTGEMVAIK IMDKNTLGSD LPRIKTEIEA   60

LKNLRHQHIC QLYHVLETAN KIFMVLEYCP GGELFDYIIS QDRLSEEETR VVFRQIVSAV  120

AYVHSQGYAH RDLKPENLLF DEYHKLKLID FGLCAKPKGN KDYHLQTCCG SLAYAAPELI  180

QGKSYLGSEA DVWSMGILLY VLMCGFLPFD DDNVMALYKK IMRGKYDVPK WLSPSSILLL  240

QQMLQVDPKK RISMKNLLNH PWIMQDYNYP VEWQSKNPFI HLDDDCVTEL SVHHRNNRQT  300

MEDLISLWQY DHLTATYLLL LAKKARGKPV RLRLSSFSCG QASATPFTDI KSNNWSLEDV  360

TASDKNYVAG LIDYDWCEDD LSTGAATPRT SQFTKYWTES NGVESKSLTP ALCRTPANKL  420

KNKENVYTPK SAVKNEEYFM FPEPKTPVNK NQHKREILTT PNRYTTPSKA RNQCLKETPI  480

KIPVNSTGTD KLMTGVISPE RRCRSVELDL NQAHMEETPK RKGAKVFGSL ERGLDKVITV  540

LTRSKRKGSA RDGPRRLKLN YNVTTTRLVN PDQLLNEIMS ILPKKNHDFV QKGYTLKCQT  600

QSDFGKVTMQ FELEVCQLQK PDVVGIRRQR LKGDAWVYKR LVEDILSSCK V
```

TABLE 20-continued

```
SEQ ID NO: 128 DNA sequence
Nucleic Acid Accession #: EOS sequence
Coding sequence: 169-1323
1          11         21         31         41         51
|          |          |          |          |          |
GGGATCCTTT CTGGAATGGA GGTCTTATGA GCTGCTATTG AACACGGCAG AGCCTGTTGG   60

TGACCTGCAC ACAGGAGCCC TCCAGTCAGT ACTGATTGAA TTACTCAAGG CTGCCTCTCT  120

GCAAAGTTGA GCACTACAGG ACGTCGGGAC TGGGCATTTC CTTCCAACAT GGCCGCCACT  180

GCCTCTCCGC AGCCACTCGC CACTGAGGAT GCCGATTCTG AGAATAGCAG CTTCTATTAC  240

TATGACTACC TGGATGAAGT GGCCTTCATG CTCTGCAGGA AGGATGCAGT GGTGTCCTTT  300

GGCAAAGTCT TCCTCCCAGT CTTCTATAGC CTGATTTTTG TGTTGGGCCT CAGCGGGAAC  360

CTCCTTCTTC TCATGGTCTT GCTCCGTTAC GTGCCTCGCA GGCGGATGGT TGAGATCTAT  420

CTGCTGAATC TGGCCATCTC CAACCTTCTG TTTCTGGTGA CACTGCCCTT CTGGGGCATC  480

TCCGTGGCCT GGCATTGGGT CTTCGGGAGT TTCTTGTGCA AGATGGTGAG CACTCTTTAT  540

ACTATTAACT TTTACAGTGG CATCTTTTTC ATTAGCTGCA TGAGCCTGGA CAAGTACCTG  600

GAGATCGTTC ATGCTCAGCC CTACCACAGG CTGAGGACCC GGGCCAAGAG CCTGCTCCTT  660

GCTACCATAG TATGGGCTGT GTCCCTGGCC GTCTCCATCC CTGATATGGT CTTTGTACAG  720

ACACATGAAA ATCCCAAGGG TGTGTGGAAC TGCCACGCAG ATTTCGGCGG GCATGGGACC  780

ATTTGGAAGC TCTTCCTCCG CTTCCAGCAG AACCTCCTAG GGTTTCTCCT TCCACTCCTT  840

GCCATGATCT TCTTCTACTC CCGTATTGGT TGTGTCTTGG TGAGGCTGAG GCCCGCAGGC  900

CAGGGCCGGG CTTTAAAAAT AGCTGCAGCC TTGGTGGTGG CCTTCTTCGT GCTATGGTTC  960

CCATACAATC TCACCTTGTT TCTGCATACG CTGTTGGACC TGCAAGTATT CGGGAACTGT 1020

GAGGTCAGCC AGCATCTAGA CTACGCACTC CAGGTAACAG AGAGCATCGC CTTCCTTCAC 1080

TGCTGCTTTT CCCCCATCCT GTATGCCTTC TCCAGTCACC GCTTCCGCCA GTACCTGAAG 1140

GCTTTCCTGG CTCCCGTGCT TGGATGGCAC CTGGCACCTG GCACTGCCCA GGCCTCATTA 1200

TCCAGCTGTT CTGAGAGCAG CATACTTACT GCCCAAGAGG AAATGACTGG CATGAATGAC 1260

CTTGGAGAGA GGCAGTCTGA GAACTACCCT AACAAGGAGG ATGTGGGGAA TAAATCAGCC 1320

TGAGTGACCA AATTTTGGTC TGGTGGGAAC AGATGGGAAC CAGCTCAATT GGGTGTCCAC 1380

TCAAAGTGCT CTCTCCAGGG GCCTCAGTGA CTGTGTTGCT AAACCCAGTG GTCAGTTCTC 1440

AGTTCTCAGC CATCAGCAGC ATTTGCTCGC CCCGCCTTCT TCCTCCACTT TCTTCACTTG 1500

CTTCCAGGAT ACCACGCTTT CTTTTCTGAA TTGCTACAAT CTTTCTTCCT TCCTTCCTTG 1560

CTTCCTTCCT TCCTTCCTTC CCTCTCTCCC TCCCTCCCTC CCTCGCTTCT TCCCTTCCTC 1620

CTTTCCTCCC TTCCTACTTT CCTTCCTTCC TTCTGACAGG GTCTTGCTCT ATTGCTCTGT 1660

CACCCAGGCT GGAATGCAGT GGCCAGATCT CCGCTCACTG TAGCCTCCTC CCCCTGGGTT 1740

GAAGCAATTC TCATGCCTCA GCCTCCCAAG TAGCCAGGAC TATAGGCACC TGCCACCATG 1800

CCTGGCTAAT TTTTGTATTT TTTTTCTTTC TTTCTTTCTT TTCTTTTTTT TTTTTTTTG  1860

AGACGGAGTC TCACTCTTGT TGCCCAGGCT GGACAACAAT GGCGCGATCT CGGCTCACTG 1920

CAACCTCCAC CTCCCGGATT CAAGCGATTC TCCTGCCTCA GCCTCCTGAG TAGCTGGAAC 1980

TACATGCGCG TGCCACCACG CACAGCTAAT TTTTATAATT TTAGTAGAGA TGGGGTTTCA 2040

CTGCGTTGGC CAGGATGATC TCGATCTCTT GACCTTGGGA TCCACCCGCC TTGGCCTCCC 2100

AAAGTGCTGG GATTACAGGT GTGAGCCACC ATGCCTGGCC CTAATTTTTG TGTTTTTATT 2160

AGAAACAGAG TTTCACCATG TTGGCCAGGC TGGAGAATTG CTGTAATAGT TTTCCAACTG 2220
```

TABLE 20-continued

```
GCCCCTGTCC TTCCTCTCTC TTGCTCTCCT CCCATCTCAT CTGCACCTAG CAGCCAGAGT    2280

GATCCTGATA CTCTCGGCCT TTACTTCCGC CTCCCTCAGA GCAGCAGCCT GTCAAAACAC    2340

CAGATTACAA CAAATTTAGT TTAAAGGTCT CAATTAGCGT TATTGGCAAT TCTAGAATCA    2400

GGCAACAGAC TCATTGAATC AGGAACAGAT TCACTCCATA AAATACAGAG AGTGCTGCAA    2460

TGAGCTGGGT AGAAGAGGTT AGTTTTATAG ACAGGAAGGG GCTGTCAAAG GCAGAAAGAA    2520

ATGAAGAACA AAAAAAAGA TTGATTTTTT TTTTTTTGAG ACAGGATCTC ACTCTGTCAT     2580

CCAGGCTGAA GTCCAATCCC ACAATCATGG CTCACTGCAG CCACCACCTC CTGAGCTCAA    2640

GTGATCCTCC CATCTAAGCC CCCAAGTAGC TAGGACTACA GGAGCACACC ACCACACCTG    2700

GCTAATTTTT GTATTTTTTG TGGAGACAGG GTCTCAGTAT GTTACCCAGG TTGGACTGGA    2760

AACCCTTGGC TCAAGCAATT TGCCTGCCTC AGCCTCCCAA AGTGCTGGGA TTACAGGCGT    2820

GAGCCACTGC ACAGGGCCAG ATTCATCATT TCAAAGTTAC TTTCTATATG CGGCCGGAAC    2880

AGGGTGGTTG ACATCAGTTT TCTTCAGGTT ACTTTTTAAT AATGATTAAA ACGGGGAACT    2940

TCATTATCAT GAGCATGGTT ACTGTCTGCA TTATTACGCC AACTGAAACT GTCATGTTTG    3000

GGAATTTGGC TGTTAACTCT GTCTCCAGGA GTCTCAAAGG TCAGATAACA ACTTAGTTTT    3060

GGTTTGAGGA CATGGAACTT TAATACGACA GATTCCATTT TGGTTTGGTC TGGTCAGCTG    3120

GGACCTAGTG CAGGAGGTTA GTCCAAAACA ATGGCCTTCC ATAGTTTTTA CTTAACAAGC    3180

CCAACTCCTT ACGGTAATCC TTTAAGGCCT ATGTGATCTG CCCTCACCCT GGCTACACTC    3240

TTTGCCCTTA TGTCCACCAG CCTCCAGTGC TCCAGACACA ACTGATCTCA AATACTCCTG    3300

ACACATCCCC CTGGGGATTC CTCTTCCTGG ATTGCTCTCC TCTCAGCTGT CTGCTTGGCT    3360

CACTCTCTCA CCTTCTGAGG TCTTAGCTCA GATACCACCT TTCACTCACC TGTCCAACCT    3420

ATTTAACACA AACTGGCCCA TCTCTGACGC TCCTGATCTT CCTGATGCTC TATTTTTAAA    3480

TTTTTTCAAT AGTGCTTATT TCTTTCAGAC ATTGTATATG TTTCTCCTAT TTGTGATGTT    3540

CAGTGGCTAC TGTCCCCACC CACATTGTCC CAGGTGAATT CCACAAGGTA GGGATCTTGG    3800

TTAGGCTCAC TGCTGTACCC AACCCCCTAA CACAGGGCCT GGTGTGTAGG TTTTCAGAAA    3880

GTATCTGTAA AATGCATGGG TGGAGGAGGG AGCATTTTCC TTCTGGCACT GCTGGGGAAA    3720

AAGAACCTAA GGCCCTCCAC TCACCAGGGT TCCACATTCT CTGTAGTCCA GCTGGGAAAT    3780

GCTATTAAAA GGACCATTCT CGTAGCCTTG ATGGTGGACC CAGCATCTGG CAATCAGGAG    3840

GGCCTTGAAG TACTCTGCCT AGGGAATGTC CCAGGACCAT ATACAGTCTG CAGAAGGAGG    3900

CAGTGAACAC ACTTGGCCTA GGCCCCATCT CAGGAGCCTT CACATCTCCC TGGGACCTGC    3960

ACAATCAAGT CCAAAATCTT TGTCTGATGT CAAGGCTAGG GCTTTTGCAA ATAGGATCCC    4020

ATACATCTTC CAGCCCTCAT ACTCCTCCAC TCCCTTTTCA TTTCCTGAAC ATTCCAACTT    4080

CTATGCCTTT GCTCTTGTGG GCTCCCTCAT GTAATTAGGA TAATTTCCAG CCAGGTATTC    4140

CCTCACCCTT GTTTTACAAC TGAATCCCAC TTTCTCTGGG ACTCCACTGC TTGGTCACTC    4200

TGCCCTGTGC TTTGAGAGGA GGTTGGGTGG AGCATGGGAC ATGGGCCATT TACTGCCTTC    4260

ACATTTCCCT GGTCACGGTG ATTTTTTTAG GGGTGGGCAC ATGACCTAGG TAGAGCCAAT    4320

GAAGTGCAAT ATCACTAGAA CATGTGAGAA GAGAGGCATG AAACCGAAGC TGAGAGGGTT    4380

TGAGATCTGG AGCTACTCCT TCCTCCACCC AAACTTCAGA AGGTGAAGGA GATAGTGCAT    4440

GTGAGTGAGC AGATCCCGAG GGCACTGTTT GAGCCTCAGA ATCAAAGCAC TTCTGAAGCT    4500

AGTCCCAATC TTGGATTCGA CAGTTACAAG AACCAATAAA TTCCTTTCCT TGTGG
```

TABLE 20-continued

SEQ ID NO: 129 Protein sequence
Protein Accession #: NP_001287.2

```
1          11         21         31         41         51
|          |          |          |          |          |
MAATASPQPL ATEDADSENS SFYYYDYLDE VAFMLCRKDA VVSFGKVFLP VFYSLIFVLG  60

LSGNLLLLMV LLRYVPRRRM VEIYLLNLAI SNLLFLVTLP FWGTSVAWHW VFGSPLCKMV 120

STLYTINFYS GIFFISCMSL DKYLEIVHAQ PYHRLRTRAK SLLLATIVWA VSLAVSIPDM 180

VFVQTHENPK GVWNCHADFG GHGTIWKLFL RFQQNLLGFL LPLLAMIFFY SRIGCVLVRL 240

RPAGQGRALK IAAALVVAFF VLWFPYNLTL FLHTLLDLQV FGNCEVSQHL DYALQVTESI 300

AFLHCCFSPI LYAFSSHRFR QYLKAFLAAV LGWNLAPGTA QASLSSCSES SILTAQEEMT 360

GMNDLGERQS ENYPNKEDVG NKSA
```

SEQ ID NO: 130 DNA sequence
Nucleic Acid Accession #: NM_002774
Coding sequence: 246. 980

```
1          11         21         31         41         51
|          |          |          |          |          |
AGGCGGACAA AGCCCGATTG TTCCTGGGCC CTTTCCCCAT CGCGCCTGGG CCTGCTCCCC   60

AGCCCGGGGC AGGGGCGGGG GCCAGTGTGG TGACACACGC TGTAGCTGTC TCCCCGGCTG  120

GCTGGCTCGC TCTCTCCTGG GGACACAGAG GTCGGCAGGC AGCACACAGA GGGACCTACG  180

GGCAGCTGTT CCTTCCCCCG ACTCAAGAAT CCCCGGAGGC CCGGAGGCCT GCAGCAGGAG  240

CGGCCATGAA GAAGCTGATG GTGGTGCTGA GTCTGATTGC TGCAGCCTGG CAGAGGAGC   300

AGAATAAGTT GGTGCATGGC GGACCCTGCG ACAAGACATC TCACCCCTAC CAAGCTGCCC  360

TCTACACCTC GGGCCACTTG CTCTGTGGTG GGTCCTTAT CCATCCACTG TGGGTCCTCA   420

CAGCTGCCCA CTGCAAAAAA CCGAATCTTC AGGTCTTCCT GGGGAAGCAT AACCTTCGGC  480

AAAGGGAGAG TTCCCAGGAG CAGAGTTCTG TTGTCCGGGC TGTGATCCAC CCTGACTATG  540

ATGCCGCCAG CCATGACCAG GACATCATGC TGTTGCGCCT GGCACGCCCA GCCAAACTCT  600

CTGAACTCAT CCAGCCCCTT CCCCTGGAGA GGGACTGCTC AGCCAACACC ACCAGCTGCC  660

ACATCCTGGG CTGGGGCAAG ACAGCAGATG GTGATTTCCC TGACACCATC CAGTGTGCAT  720

ACATCCACCT GGTGTCCCGT GAGGAGTGTG AGCATGCCTA CCCTGGCCAG ATCACCCAGA  780

ACATGTTGTG TGCTGGGGAT GAGAAGTACG GGAAGGATTC CTGCCAGGGT GATTCTGGGG  840

GTCCGCTGGT ATGTGGAGAC CACCTCCGAG GCCTTGTGTC ATGGGGTAAC ATCCCCTGTG  900

GATCAAAGGA GAAGCCAGGA GTCTACACCA ACGTCTGCAG ATACACGAAC TGGATCCAAA  960

AAACCATTCA GGCCAAGTGA CCCTGACATG TGACATCTAC CTCCCGACCT ACCACCCCAC 1020

TGGCTGGTTC CAGAACGTCT CTCACCTAGA CCTTGCCTCC CCTCCTCTCC TGCCCAGCTC 1080

TGACCCTGAT GCTTAATAAA CGCAGCGACG TGAGGGTCCT GATTCTCCCT GGTTTTACCC 1140

CAGCTCCATC CTTGCATCAC TGGGGAGGAC GTGATGAGTG AGGACTTGGG TCCTCCGTCT 1200

TACCCCCACC ACTAAGAGAA TACAGGAAAA TCCCTTCTAG GCATCTCCTC TCCCCAACCC 1260

TTCCACACGT TTGATTTCTT CCTGCAGAGG CCCAGCCACG TGTCTGGAAT CCCAGCTCCG 1320

CTGCTTACTG TCGGTGTCCC CTTGGGATGT ACCTTTCTTC ACTGCAGATT TCTCACCTGT 1380

AAGATGAAGA TAAGGATGAT ACAGTCTCCA TCAGGCAGTG GCTGTTGGAA AGATTTAAGA 1440

TTTCACACCT ATGACATACA TGGGATAGCA CCTGCGCCGC CATGCACTCA ATAAACAATG 1500

TATTTT
```

TABLE 20-continued

SEQ ID NO: 131 Protein sequence
Protein Accession #: NP_002765

```
1           11          21          31          41          51
|           |           |           |           |           |
MKKLMVVLSL  IAAAWAEEQN  KLVHGGPCDK  TSHPYQAALY  TSGHLLCGGV  LIHPLWVLTA   60

AHCKKPNLQV  FLGKHNLRQR  ESSQEQSSVV  RAVIHPDYDA  ASHDQDIMLL  RLARPAKLSE  120

LIQPLPLERD  CSANTTSCHI  LGWGKTADGD  FPDTIQCAYI  HLVSREECEH  AYPGQITQNM  180

LCAGDEKYGK  DSCQGDSGGP  LVCGDHLRGL  VSWGNIPCGS  KEKPGVYTNV  CRYTNWIQKT  240

IQAK
```

SEQ ID NO: 132 DNA sequence
Nucleic Acid Accession #: AY038071 1
Coding sequence: 1..1685

```
1           11          21          31          41          51
|           |           |           |           |           |
ATGAGCAATC  AGTACCACGA  GGAGGGCTGC  TCCGAGAGGC  CCGAGTGCAA  AAGTAAATCT   60

CCAACTTTGC  TCTCCTCCTA  CTGCATCGAC  AGCATCCTGG  GCCGGAGGAG  CCCGTGCAAA  120

ATGCGGTTGC  TGGGAGCCGC  GCAGAGCTTG  CCTGCTCCGC  TGACCAGCCG  CGCCGACCCG  180

GAAAAGGCCG  TGCAAGGCTC  CCCTAAGAGC  AGCAGCGCCC  CGTTCGAGGC  CGAGCTGCAC  240

CTGCCGCCCA  AGCTGCGGCG  CCTGTACGGC  CCGGGCGGGG  GCCGCCTCCT  TCACGGTGCG  300

GCAGCGGCGG  CGGCGGCGGC  GGCGGCGGCG  GCGGCAGCGG  CCGCCACGGC  CACGGCGGGT  360

CCACGCGGGG  AGGCCCCTCC  GCCGCCACCG  CCAACCGCGC  GGCCCGGGGA  ACGGCCGGAC  420

GGCGCAGGGG  CCGCCGCGGC  AGCCGCGGCC  GCGGCCGCCG  CGGCCTGGGA  CACGCTCAAG  480

ATCAGCCAGG  CGCCGCAGGT  GAGCATCAGC  CGCAGCAAGT  CGTACCGCGA  GAACGGGGCG  540

CCCTTCGTGC  CGCCGCCGCC  CGCGCTGGAC  GAGCTGGGCG  GCCGGGGGG  CGTCACGCAC  600

CCGGAGGAGC  GCCTCGGCGT  GGCCCGCGGC  CCGGGCAGCG  CCCCGGCTGC  GGGTGGTGGC  660

ACCGGCACCG  AGGACGACGA  GGAGGAGCTG  CTGGAGGACA  AGAAGATGA  GGACGAGGAA  720

GAGGAACTGC  TGGAGGACGA  CGAGGAGGAG  CTGCTGGAGG  ACGACGCCCG  CGCGCTGCTC  780

AAGGAGCCCC  GGCGCTGTCC  TGTGGCCGCC  ACTGGCGCCG  TGGCCGCAGC  AGCTGCCGCT  840

GCAGTGGCCA  CAGAGGGCGG  GGAGCTGTCA  CCCAAGGAGC  AGCTGCTGCT  GCACCCCGAA  900

GACGCTGAGG  GCAAGGACGG  CGAGGACAGC  GTGTGCCTCT  CTGCGGGCAG  CGACTCGGAG  960

GAGGGGCTGC  TGAAACGCAA  ACAGAGGCGC  TACCGCACCA  CGTTCACCAG  CTACCAGCTG  1020

GAGGAACTGG  AGCGGGCCTT  CCAGAAGACG  CACTACCCGG  ACGTCTTCAC  CAGGGAGGAA  1080

CTGGCCATGA  GGCTGGACTT  GACCGAGGCC  CGAGTCCAGG  TCTGGTTCCA  GAACCGTCGG  1140

GCCAAGTGGC  GCAAGCGGGA  GAAGGCAGGC  GCGCAGACCC  ACCCCCCTGG  GCTGCCCTTC  1200

CCGGGGCCGC  TCTCCGCCAC  CCACCCGCTC  AGCCCCTACC  TGGACGCCAG  CCCCTTCCCT  1260

CCGCACCACC  CGGCGCTCGA  CTCCGCTTGG  ACTGCCGCTG  CCGCCGCCGC  CGCCGCCGCC  1320

TTCCCGAGCC  TACCTCCGCC  TCCGGGCTCG  GCCAGCCTGC  CGCCCAGCGG  GGCGCCGCTG  1380

GGCCTGAGCA  CTTTCCTCGG  AGCGGCAGTG  TTCCGACACC  CAGCTTTCAT  CAGCCCGGCA  1440

TTCGGCAGGC  TCTTTTCCAC  AATGGCCCCC  CTGACCAGCG  CGTCGACCGC  GGCCGCGCTC  1500

CTGAGACAGC  CCACACCCGC  CGTGGAGGGC  GCAGTGGCAT  CGGGCCCCCT  GGCCGACCCG  1560

GCCACGGCCG  CCGCAGACAG  ACGCGCCTCT  AGCATAGCCG  CGCTGAGGCT  CAAGGCCAAG  1620

GAGCACGCGG  CGCAGCTCAC  GCAGCTCAAC  ATCCTGCCGG  GCACCACCAC  GGGCAAGGAG  1680

GTGTGC
```

TABLE 20-continued

```
SEQ ID NO: 133 protein sequence
Protein Accession #: AAK93901.1
1          11         21         31         41         51
|          |          |          |          |          |
MSNQYQEEGC SERPECKSKS PTLLSSYCID SILGRRSPCK MRLLGAAQSL PAPLTSRADP  60

EKAVQGSPKS SSAPFEAELH LPPKLRRLYG PGGGRLLQGA AAAAAAAAAA AAAAATATAG 120

PRGEAPPPPP PTARPGERPD GAGAAAAAAA AAAAAWDTLK ISQAPQVSIS RSKSYRENGA 180

PFVPPPPALD ELGGPGGVTH PEERLGVAGG PGSAPAAGGG TGTEDDEEEL LEDEEDEDEE 240

EELLEDDEEE LLEDDARALL KEPRRCPVAA TGAVAAAAAA AVATEGGELS PKEELLLHPE 300

DAEGKDGEDS VCLSAGSDSE EGLLKRKQRR YRTTFTSYQL EELERAFQKT HYPDVFTREE 360

LAMRLDLTEA RVQVNFQNRR AKWRKREKAG AQTNPPGLPF PGPLSATHPL SPYLDASPFP 420

PHHPALDSAW TAAAAAAAAA FPSLPPPPGS ASLPPSGAPL GLSTFLGAAV FRNPAFISPA 480

FGRLFSTMAP LTSASTAAAL LRQPTPAVEG AVASGALADP ATAAADRRAS SIAALRLKAK 540

EHAAQLTQLN ILPGTSTGKE VC

SEQ ID NO: 134 DNA sequence
Nucleic Acid Accession #: CAT cluster
1          11         21         31         41         51
|          |          |          |          |          |
TTTTTTTTTT TTTTTTTAAA GCAGATCATC TCTCCAAATC ATCACTTCTA TCAAGCCTAT  60

TGCTTGAGCA GTGTTATAGC ACTCAGCCCT CAGGGCAAAG ATAAGTCTTC ACCATTGTCA 120

CACGTAGCAC ACACATATTC AGCCATATCA TGCTGAATGG GAATACAGGA CTTTGTAGAA 180

ACAGAACTGA TTCCTGCAGA ATATCCTGAG ATACTTATCA AGCTGTTAAA GGAGACATCA 240

GTCTTTTGTC TGTATTGCCC TTGACACCTC CTCAAGGAAA GTATCTAGAA ATTCTTTGTC 300

TTCTGAAGAA CCCTCAGACC TCTTAGGTCT AATGTAGGTT AAGTGCCCTG CAGATCTCCC 360

TAGAATAGAA AAGCACCTTG AAAACTGTAG TCTGACTTAA TAGACACAAA TATAATGAAA 420

GCACTAATTC ATAAGATCCT GTTATTTGAA GGAAAAAGCA GCAAAAGGCA CAAGCTTCAG 480

ATATTGGTCT TGCACAGGAA AAAGCTGGAA TTCTACC

SEQ ID NO: 135 DNA sequence
Nucleic Acid Accession #: NM_006799
Coding sequence. 19..963
1          11         21         31         41         51
|          |          |          |          |          |
GCCGCGGGAG AGGAGGCCAT GGGCGCGCGC GGGGCGCTGC TGCTGGCGCT GCTGCTGGCT  60

CGGGCTGGAC TCAGGAAGCC GGAGTCGCAG GAGGCGGCGC CGTTATCAGG ACCATGCGGC 120

CGACGGGTCA TCACGTCGCG CATCGTGGGT GGAGAGGACG CCGAACTCGG GCGTTGGCCG 180

TGGCAGGGGA GCCTGCGCCT GTGGGATTCC CACGTATGCG GAGTGAGCCT GCTCAGCCAC 240

CGCTGGGCAC TCACGGCGGC GCACTGCTTT GAAACCTATA GTGACCTTAG TGATCCCTCC 300

GGGTGGATGG TCCAGTTTGG CCAGCTGACT TCCATGCCAT CCTTCTGGAG CCTGCAGGCC 360

TACTACACCC GTTACTTCGT ATCGAATATC TATCTGAGCC CTCGCTACCT GGGGAATTCA 420

CCCTATGACA TTGCCTTGGT GAAGCTGTCT GCACCTGTCA CCTACACTAA ACACATCCAG 460

CCCATCTGTC TCCAGGCCTC CACATTTGAG TTTGAGAACC GGACAGACTG CTGGGTGACT 540

GGCTGGGGGT ACATCAAAGA GGATGAGGCA CTGCCATCTC CCCACACCCT CCAGGAAGTT 600

CAGGTCGCCA TCATAAACAA CTCTATGTGC AACCACCTCT TCCTCAAGTA CAGTTTCCGC 660

AAGGACATCT TTGGAGACAT GGTTTGTGCT GGCAATGCCC AAGGCGGGAA GGATGCCTGC 720

TTCGGTGACT CAGGTGGACC CTTGGCCTGT AACAAGAATG ACTGTGGTA TCAGATTGGA 780

GTCGTGAGCT GGGGAGTGGG CTGTGGTCGG CCCAATCGGC CCGGTGTCTA CACCAATATC 840
```

TABLE 20-continued

```
AGCCACCACT TTGAGTGGAT CCAGAAGCTG ATGGCCCAGA GTGGCATGTC CCAGCCAGAC   900

CCCTCCTGGC CGCTACTCTT TTTCCCTCTT CTCTGGGCTC TCCCACTCCT GGGGCCGGTC   960

TGAGCCTACC TGAGCCCATG CAGCCTGGGG CCACTGCCAA GTCAGGCCCT GGTTCTCTTC  1020

TGTCTTGTTT GGTAATAAAC ACATTCCAGT TGATGCCTTG CAGGGCATTC TTCAAAA
```

SEQ ID NO: 136 Protein sequence
Protein Accession #: NP_006790

```
1          11         21         31         41         51
|          |          |          |          |          |
MGARGALLLA LLLARAGLRK PESQEAAPLS GPCGRRVITS RIVGGEDAEL GRWPWQGSLR   60

LWDSHVCGVS LLSHRWALTA AHCFETYSDL SDPSGWMVQF GQLTSMPSFW SLQAYYTRYF  120

VSNIYLSPRY LGNSPYDIAL VKLSAPVTYT KHIQPICLQA STEEFENRTD CWVTGWGYIK  180

EDEALPSPHT LQEVQVAIIN NSMCNHLFLK YSFRKDIFGD MVCAGNAQGG KDACFGDSGG  240

PLACNKNGLW YQIGVVSWGV GCGRPNRPGV YTNISHHFEW IQKLMAQSGM SQPDPSWPLL  300

FFPLLWALPL LGPV
```

SEQ ID NO: 137 DNA sequence
Nucleic Acid Accession #: Eos sequence
Coding sequence: 1..939

```
1          11         21         31         41         51
|          |          |          |          |          |
ATGGGCGCGC GCGGGGCGCT GCTGCTGGCG CTGCTGCTGG CTCGGGCTGG ACTCAGGAAG   60

CCGGAGTCGC AGGAGGCGGC GCCCTTATCA GGACCATGCG GCCGACGGGT CATCACGTCG  120

CGCATCGTGG GTGGAGAGGA CGCCGAACTC GGGCGTTGGC CGTGGCAGGG GAGCCTGCGC  180

CTGTGGGATT CCCACGTATG CGGAGTGAGC CTGCTCAGCC ACCGCTGGGC ACTCACGGCG  240

GCGCACTGCT TTGAAACTGA CCTTAGTGAT CCCTCCGGGT GGATGGTCCA GTTTGGCCAG  300

CTGACTTCCA TGCCATCCTT CTGGAGCCTG CAGGCCTACT ACACCCGTTA CTTCGTATCG  360

AATATCTATC TGAGCCCTCG CTACCTGGGG AATTCACCCT ATGACATTGC CTTGGTGAAG  420

CTGTCTGCAC CTGTCACCTA CACTAAACAC ATCCAGCCCA TCTGTCTCCA GGCCTCCACA  480

TTTGAGTTTG AGAACCGGAC AGACTGCTGG GTGACTGGCT GGGGGTACAT CAAAGAGGAT  540

GAGGCACTGC CATCTCCCCA CACCCTCCAG GAAGTTCAGG TCGCCATCAT AAACAACTCT  600

ATGTGCAACC ACCTCTTCCT CAAGTACAGT TTCCGCAAGG ACATCTTTGG AGACATGGTT  660

TGTGCTGGCA ATGCCCAAGG CGGGAAGGAT GCCTGCTTCG GTGACTCAGG TGGACCCTTG  720

GCCTGTAACA AGAATGGACT GTGGTATCAG ATTGGAGTCG TGAGCTGGGG AGTGGGCTGT  780

GGTCGGCCCA ATCGGCCCGG TGTCTACACC AATATCAGCC ACCACTTTGA GTGGATCCAG  840

AAGCTGATGG CCCAGAGTGG CATGTCCCAG CCAGACCCCT CCTGGCCACT ACTCTTTTTC  900

CCTCTTCTCT GGGCTCTCCC ACTCCTGGGG CCGGTCTGA
```

SEQ ID NO: 138 Protein sequence
Protein Accession #: Eos sequence

```
1          11         21         31         41         51
|          |          |          |          |          |
MGARGALLLA LLLARAGLRK PESQEAAPLS GPCGRRVITS RIVGGEDAEL GRWPWQGSLR   60

LWDSHVCGVS LLSHRWALTA AHCFETDLSD PSGWMVQFGQ LTSMPSFWSL QAYYTRYFVS  120

NIYLSPRYLG NSPYDIALVK LSAPVTYTKH IQPICLQAST FEFENRTDCW VTGWGYIKED  180

EALPSPHTLQ EVQVAIINNS MCNHLFLKYS FRKDIFGDMV CAGNAQGGKD ACFGDSGGPL  240

ACNKNGLWYQ IGVVSWGVGC GRPNRPGVYT NISHHFEWIQ KLMAQSGMSQ PDPSWPLLFF  300

PLLWALPLLG PV
```

TABLE 20-continued

```
SEQ ID NO: 139 DNA sequence
Nucleic Acid Accession #: NM_014344
Coding sequence: 131..1444
1          11         21         31         41         51
|          |          |          |          |          |
GCGGCCGCGA TGGGGCCGAA GCGCCCGAAG CCCCGGAGCC CACAAACTGC CGGGCCCGCC   60

TCGCCGCCGG GACCCGGGTG CCTGGGCTCG GCTTGAAGCG GCGGCGGCGC ACCGGCACAG  120

CCGCGGGAGC ATGGGCAGGA GGATGCGGGG CGCCGCCGCC ACCGCGGGGC TCTGGCTGCT  180

GGCGCTGGGC TCGCTGCTGG CGCTGTGGGG AGGGCTCCTG CCGCCGCGGA CCGAGCTGCC  240

CGCCTCCCGG CCGCCCGAAG ACCGACTCCC ACGGCGCCCG GCCGGAGCG GCGGCCCCGC  300

GCCCGCGCCT CGCTTCCCTC TGCCCCCGCC CCTGGCGTGG GACGCCCGCG GCGGCTCCCT  360

GAAAACTTTC CGGGCGCTGC TCACCCTGGC GGCCGGCGCG GACGGCCCGC CCCGGCAGTC  420

CCGGAGCGAG CCCAGGTGGC ACGTGTCAGC CAGGCAGCCC CGGCCGGAGG AGAGCGCCGC  480

GGTGCACGGG GGCGTCTTCT GGAGCCGCGG CCTGGAGGAG CAGGTGCCCC CGGGCTTTTC  540

GGAGGCCCAG GCGGCGGCGT GGCTGGAGGC GGCTCGCGGC GCCCGGATGG TGGCCCTGGA  000

GCGCGGGGGT TGCGGGCGCA GCTCCAACCG ACTGGGCCCGT TTTGCCGACG GCACCCGCGC  660

CTGCGTGCGC TACGGCATCA ACCCGGAGCA GATTCAGGGC GAGGCCCTGT CTTACTATCT  720

GGCGCGCCTG CTGGGCCTCC AGCGCCACGT GCCGCCGCTG GCACTGGCTC GGGTGGAGGC  780

TCGGGCGCG CAGTGGGCGC AGGTGCAGGA GGAGCTGCGC GCTGCGCACT GGACCGAGGG  840

CAGCGTGGTG AGCCTGACAC GCTGGCTGCC CAACCTCACG GACGTGGTGG TGCCCGCGCC  900

CTGGCGCTCG GAGGACGGCC GTCTGCGCCC CCTCCGGGAT GCCGGGGGTG AGCTGGCCAA  960

CCTCAGCCAG GCGGAGCTGG TGGACCTAGT ACAATGGACC GACTTAATCC TTTTCGACTA 1020

CCTGACGGCC AACTTCGACC GGCTCGTAAG CAACCTCTTC AGCCTGCAGT GGGACCCGCG 1080

CGTCATGCAG CGTGCCACCA GCAACCTGCA CCGCGGTCCG GCGGGGCGC TGGTCTTTCT 1140

GGACAATGAG GCGGGCTTGG TGCACGGCTA CCGGGTAGCA GGCATGTGGG ACAAGTATAA 1200

CGAGCCGCTG TTGCAGTCAG TGTGCGTGTT CCGCGAGCGG ACCGCGCGGC GCGTCCTGGA 1260

GCTGCACCGC GGACAGGACG CCGCGGCCCG GCTGCTGCGC CTCTACCGGC GCCACGAGCC 1320

TCGCTTCCCC GAGCTGGCCG CCCTTGCAGA CCCCCACGCT CAGCTGCTAC AGCGCCGCCT 1380

CGACTTCCTG GCCAAGCACA TTTTGCACTG TAAGGCCAAG TACGGCCGCC GGTCTGGGAC 1440

TTAGTGTCAC CGGGAGGAAA AGAGAGAGAT CTGGGGCTGG GGTATGGATG ATGGGGGGAA 1500

GGGCGGTCGC CTCTGCCACT GTCAGGGACC AGCCGGCCAA CGCCCACCCG CAAAGGTGTC 1560

TAAAAACTTC AGCTTTTCAC CCACCTGCCC CTTTCTTTCA ATCCCACGCT GTTTCCTTTC 1620

AAAGTTCTGG GAGGACGAAC TCACCGAGGC GAGAAGTGTA ACATTCTCTC CACCCAGCTT 1680

ATAAAAGGAT TCTTTACTGT GCCAGCACGG GGATTGGATC CGAAGAAACT GGCTACTGGG 1740

GTTTGGCCCC CGAGTGGCCG TCCCTGTGGG AGATGCACCC CATTCTTGGG CCCCCCTCAT 1800

TCCCTTTCCG AAAAAGGAAA ACTTGCGTTT GAGCCGTTGA GCTAATTCTG CAATTTTCTA 1860

CCAAACAGAG CGCTGGTGGC CCCGGAGCAG GGCTGTGACA TTGGCTGGTG GAGCCCCTTC 1920

CTGTGTTCTC CCTTTGTTCC AGCGCCGCGA TGGTGAGATC ACTGTTCCAA GCAGGGGAC 1980

GGCTCGCGAT AGGACAAAGA GAGCAGGACC TCCAGACTCT GGGGAGCCCT GCAGACCTTG 2040

ACAATTTGCC TGACTCATTC CTGACCTCTT GTCATTTTGG CCTGAAGGCT ACAAATTCAG 2100

GGTCAGCTGT ATGCACTAAG TCAAATAATG AATTTCTTCC TCCCTCTCGC AACCGACCAA 2160

AATTTTGACA ACGATGATGT TCACCAGAAG GAAAAAAAAA TCAGTTTTAT GCACTTTATT 2220
```

TABLE 20-continued

```
TTGTTTTGAT TTTCATTTTT TATTAAGAAA AAATTTTATT TTACAGAATT TACCTTCTCT   2280

GTATATATGT GCATAAAGTG TGGTGTAAAT ATACTAAACA AACTTATATT TCAATAAAAG   2340

GGAGTTTAAA ATTTAAAAAA AAAAAAA

SEQ ID NO: 140 protein sequence
Protein Accession #: NP_055159
1          11         21         31         41         51
|          |          |          |          |          |
MGRRNRGAAA TAGLWLLALG SLLALWGGLL PPRTELPASR PPEDRLPRRP ARSGGPAPAP   60

RFPLPPPLAW DARGGSLKTF RALLTLAAGA DGPPRQSRSE PRWHVSARQP RPEESAAVHG   120

GVFWSRGLEE QVPPGFSEAQ AAAWLEAARG ARMVALERGG CGRSSNRLAR FADGTRACVR   180

YGINPEQIQG EALSYYLARL LGLQRHVPPL ALARVEARGA QWAQVQEELR AAHWTEGSVV   240

SLTRWLPNLT DVVVPAPWRS EDGRLRPLRD AGGELANLSQ AELVDLVQWT DLILFDYLTA   300

NFGRLVSNLF SLQWDPRVMQ RATSNLHRGP GGALVFLDNE AGLVHGYRVA GMWDKYNEPL   360

LQSVCVFRER TARRVELEHR GQDAAARLLR LYRRHEPRFP ELAALADPHA QLLQRRLDFL   420

AKHILHCKAK YGRRSGT

SEQ ID NO: 141 DNA sequence
Nucleic Acid Accession #: Eos sequence
Coding sequence: 11..574
1          11         21         31         41         51
|          |          |          |          |          |
GTCCGCCAAG ATGCCTGCCC CAGTCCCTCT GCTGTCTGCA GCCCAGCCTT CACCCTCTTG   60

CATGGGAAAA TCGTCTACAG ACTTCTGCCC ATGGCTGTAT GTACGCACGG ACAGAGCTAG   120

CAATGACCCT GCTGGCAGGT ATGATAGGAA GCCTCTTCTG TCACAGGATT CATTCCCAGA   180

CAATGACCCC AAATGCCTGT CCCTGCTCCC CCCACCCCCC AACATCAAAA TAGCCGAGAA   240

AAATGCCCTT CTCGGAGCCA AATGTGTGGT GATGCCTTAC AATCAGAAAT TCCTACAGTG   300

GCCTGAGGCT TCCACCACTA AACGCAAAGC TGTAGATACC TATTGCTTGG ATTATAAGCC   360

TTCCAAGGGA AGAAGGTGGG CTGCAAGAGC ACCAAGCACC AGAATCACAT ATGGGACTAT   420

CACCAAAGAG AGAGACTACT GCGCGGAAGA CCAGACTATC GAGAGCTGGA GAGAAGAAGG   480

TTTCCCCAGTG GGCTTGAAGC TTGCTGTGCT TGGTATTTTC ATCATTGTGG TGTTTGTCTA   540

CCTGACTGTG GAAAATAAGT CGCTGTTTGG TTAAGTAATT TAGG

SEQ ID NO: 142 Protein sequence
Protein Accession #: Eos sequence
1          11         21         31         41         51
|          |          |          |          |          |
MPAPVPLLSA AQPSPSCMGK SSTDFCPWLY VRTDRASNDP AGRYDRKPLL SQDSFPDNDP   60

KCLSLLPPPP NIKIAEKNAL LGAKCVVMPY NQKFLQWPEA STTKRKAVDT YCLDYKPSKG   120

RRWAARAPST RITYGTITKE RDYCAEDQTI ESWREEGFPV GLKLAVLGIF IIVVFVYLTV   180

ENKSLFG

SEQ ID NO: 143 DNA sequence
Nucleic Acid Accession #: XM_050184 6
Coding sequence: 39..365
1          11         21         31         41         51
|          |          |          |          |          |
GATTCTACCA TCAGAAAAGA GGCCAAACTT CTATCATCAT GGTGGATGTG AAGTGTCTGA   60

GTGACTGTAA ATTGCAGAAC CAACTTGAGA AGCTTGGATT TCACCTGGCC CAATACTAC   120

CTTCCACCAG AAAGTTGTAT GAAAAAAAGT TAGTACAGTT GTTGGTCTCA CCTCCCTGTG   180

CACCACCTGT GATGAATGGA CCCAGAGAGC TGGATGGAGC GCAGGACAGT GATGACAGCG   240

AAGGTGGGCT GCAAGAGCAC CAAGCACCAG AATCACATAT GGGACTATCA CCAAAGAGAG   300

AGACTACTGC GCGGAAGACC AGACTATCGA GAGCTGGAGA AGAAGGTT TCCCAGTGGG   360
```

TABLE 20-continued

```
CTTGAAGCTT GCTGTGCTTG GTATTTTCAT CATTGTGGTG TTTGTCTACC TGACTGTGGA   420

AAATAAGTCG CTGTTTGGTT AAGTAATTTA GGAGCAAAGC AATGCTCCAA GCGAGGCCTC   480

CTGCTTCAGG AAAGAACCAA AACACTACCC TGAAGGGCCA GCCTAGCCTG CAGCCCTCCC   540

TTGCAGGGAG CCTTCCCTTG CACTGTGCTG CTCTCACAGA TCGGTGTCTG GGCTCAGCCA   600

GGTGGAAGGA ACCTGCCTAA CCAGGCACCT GTGTTAAGAG CATGATGGTT AGGAAATCCC   660

CCAAGTCATG TCAACTCTCA TTAAAGGTGC TTCCATATTT GAGCAGGCGT CAAAC

SEQ ID NO: 144 Protein sequence
Protein Accession #: XP_050184.1
1          11         21         31         41         51
|          |          |          |          |          |
MVDVKCLSDC KLQNQLEKLG FSPGPILPST RKLYEKKLVQ LLVSPPCAPP VMNGPRELDG   60

AQDSDDSEGG LQEHQAPESH MGLSPKRETT ARKTRLSRAG EKKVSQWA

SEQ ID NO: 145 DNA sequence
Nucleic Acid Accession #: NM_002204.1
Coding sequence: 74. 3229
1          11         21         31         41         51
|          |          |          |          |          |
AGGTGAACAG GTCCTCACGC CCAGCTCCGC CCCCTCACGC GCTCTCGCCG GGACCCCGCT   60

TCCGCTGGCA GCCATGGGCC CCGGCCCCAG CCGCGCGCCC CGCGCCCCAC GCCTGATGCT   120

CTGTGCGCTC GCCTTGATGG TGGCGGCCGG CGGCTGCGTC GTCTCCGCCT TCAACCTGGA   180

TACCCGATTC CTGGTAGTGA AGGAGGCCGG GAACCCGGGC AGCCTCTTCG CTACTCGGT   240

CGCCCTCCAT CGGCAGACAG AGCGGCAGCA GCGCTACCTG CTCCTGGCTG GTCCCCCCCG   300

GGAGCTCGCT GTGCCCGATG GCTACACCAA CCGGACTGGT GCTGTGTACC TGTGCCCACT   360

CACTGCCCAC AAGGATGACT GTGAGCGGAT GAACATCACA GTGAAAAATG ACCCTGGCCA   420

TCACATTATT GAGGACATGT GGCTTGGAGT GACTGTGGCC AGCCAGGGCC CTGCAGGCAG   480

AGTTCTGGTC TGTGCCCACC GCTACACCCA GGTGCTGTGG TCAGGGTCAG AAGACCAGCG   540

GCGCATGGTG GGCAAGTGCT ACGTGCGAGG CAATGACCTA GAGCTGGACT CCAGTGATGA   600

CTGGCAGACC TACCACAACG AGATGTGCAA TAGCAACACA GACTACCTGG AGACGGGCAT   660

GTGCCAGCTG GGCACCAGCG GTGGCTTCAC CCAGAACACT GTGTACTTCG CGCCCCCGG   720

TGCCTACAAC TGGAAAGGAA ACAGCTACAT GATTCAGCGC AAGGAGTGGG ACTTATCTGA   780

GTATAGTTAC AAGGACCCAG AGGACCAAGG AAACCTCTAT ATTGGGTACA CGATGCAGGT   840

AGGCAGCTTC ATCCTGCACC CAAAAACAT CACCATTGTG ACAGGTGCCC ACGGCACCG   900

ACATATGGGC GCGGTGTTCT TGCTGAGCCA GGAGGCAGGC GGAGACCTGC GGAGGAGGCA   960

GGTGCTGGAG GGCTCGCAGG TGGGCGCCTA TTTTGGCAGC GCAATTGCCC TGGCAGACCT   1020

GAACAATGAT GGGTGGCAGG ACCTCCTGGT GGGCGCCCCC TACTACTTCG AGAGGAAAGA   1080

GGAAGTAGGG GGTGCCATCT ATGTCTTCAT GAACCAGGCG GGAACCTCCT TCCCTGCTCA   1140

CCCCTCACTC CTTCTTCATG GCCCCAGTGG CTCTGCCTTT GGTTTATCTG TGGCCAGCAT   1200

TGGTGACATC AACCAGGATG GATTTCAGGA TATTGCTGTG GGAGCTCCGT TTGAAGGCTT   1260

GGGCAAAGTG TACATCTATC ACAGTAGCTC TAAGGGGCTC CTTAGACAGC CCCAGCAGGT   1320

AATCCATGGA GAGAAGCTGG GACTGCCTGG GTTGGCCACC TTCGGCTATT CCCTCAGTGG   1380

GCAGATGGAT GTGGATGAGA ACTTCTACCC AGACCTTCTA GTGGGAAGCC TGTCAGACCA   1440

CATTGTGCTG CTGCGGGCCC GGCCAGTCAT CAACATCGTC ACAAGACCT TGGTGCCCAG   1500

GCCAGCTGTG CTGGACCCTG CACTTTGCAC GGCCACCTCT TGTGTGCAAG TGGAGCTGTG   1560

CTTTGCTTAC AACCAGAGTG CCGGGAACCC CAACTACAGG CGAAACATCA CCCTGGCCTA   1620
```

TABLE 20-continued

```
CACTCTGGAG GCTGACAGGG ACCGCCGGCC GCCCCGGCTC CGCTTTGCCG GCAGTGAGTC 1680
CGCTGTCTTC CACGGCTTCT TCTCCATGCC CGAGATGCGC TGCCAGAAGC TGGAGCTGCT 1740
CCTGATGGAC AACCTCCGTG ACAAACTCCG CCCCATCATC ATCTCCATGA ACTACTCTTT 1800
ACCTTTGCGG ATGCCCGATC GCCCCCGGCT GGCGCTGCGG TCCCTGGACG CCTACCCGAT 1860
CCTCAACCAG GCACAGGCTC TGGAGAACCA CACTGAGGTC CAGTTCCAGA AGGACTGCGG 1920
GCCTGACAAC AAGTGTGAGA GCAACTTGCA CATGCGGGCA GCCTTCGTGT CAGAGCAGCA 1980
GCAGAAGCTG AGCAGGCTCC AGTACAGCAG AGACGTCCGG AAATTGCTCC TGAGCATCAA 2040
CGTGACGAAC ACCCGGACCT CGGAGCGCTC CGGGGAGGAC GCCCACGAGG CGCTGCTCAC 2100
CCTGGTGGTG CCTCCCGCCC TGCTGCTGTC CTCAGTGCGC CCCCCGGGG CCTGCCAAGC 2160
TAATGAGACC ATCTTTTGCG AGCTGGGAA CCCCTTCAAA CGGAACCAGA GGATGGAGCT 2220
GCTCATCGCC TTTGAGGTCA TCGGGGTGAC CCTGCACACA AGGGACCTTC AGGTGCAGCT 2280
GCAGCTCTCC ACGTCGAGTC ACCAGGACAA CCTGTGGCCC ATGATCCTCA CTCTGCTGGT 2340
GGACTATACA CTCCAGACCT CGCTTAGCAT GGTAAATCAC CGGCTACAAA GCTTCTTTGG 2400
GGGGACAGTG ATGGGTGAGT CTGGCATGAA AACTGTGGAG GATGTAGGAA GCCCCCTCAA 2460
GTATGAATTC CAGGTGGGCC CAATGGGGGA GGGGCTGGTG GGCCTGGGGA CCCTGGTCCT 2520
AGGTCTGGAG TGGCCCTACG AAGTCAGCAA TGGCAAGTGG CTGCTGTATC CCACGGAGAT 2580
CACCGTCCAT GGCAATGGGT CCTGGCCCTG CCGACCACCT GGAGACCTTA TCAACCCTCT 2640
CAACCTCACT CTTTCTGACC CTGGGGACAG GCCATCATCC CCACAGCGCA GGCGCCGACA 2700
GCTGGATCCA GGGGGAGGGC AGGGCCCCCC ACCTGTCACT CTGGCTGCTG CCAAAAAAGC 2760
CAAGTCTGAG ACTGTGCTGA CCTGTGCCAC AGGGCGTGCC CACTGTGTGT GGCTAGAGTG 2820
CCCCATCCCT GATGCCCCCG TTGTCACCAA CGTGACTGTG AAGGCACGAG TGTGGAACAG 2880
CACCTTCATC GAGGATTACA GAGACTTTGA CCGAGTCCGG GTAAATGGCT GGGCTACCCT 2940
ATTCCTCCGA ACCAGCATCC CCACCATCAA CATGGAGAAC AAGACCACGT GGTTCTCTGT 3000
GGACATTGAC TCGGAGCTGG TGGAGGAGCT GCCGGCCGAA ATCGAGCTGT GGCTGGTGCT 3060
GGTGGCCGTG GGTGCAGGGC TGCTGCTGCT GGGGCTGATC ATCCTCCTGC TGTGGAAGTG 3120
CGGCTTCTTC AAGCGAGCCC GCACTCGCGC CCTGTATGAA GCTAAGAGGC AGAAGGCGGA 3180
GATGAAGAGC CAGCCGTCAG AGACAGAGAG GCTGACCGAC GACTACTGAG GGGGCAGCCC 3240
CCCGCCCCCG GCCCACCTGG TGTGACTTCT TTAAGCGGAC CCGCTATTAT CAGATCATGC 3300
CCAAGTACCA CGCAGTGCGG ATCCGGGAGG AGGAGCGCTA CCCACCTCCA GGGAGCACCC 3360
TGCCCACCAA GAAGCACTGG GTGACCAGCT GGCAGACTCC GGACCAATAC TACTGACGTC 3420
CTCCCTGATC CCACCCCCTC CTCCCCCAGT GTCCCCTTTC TTCCTATTTA TCATAAGTTA 3480
TGCCTCTGAC AGTCCACAGG GGCCACCACC TTTGGCTGGT AGCAGCAGGC TCAGGCACAT 3540
ACACCTCGTC AAGAGCATGC ACATGCTGTC TGGCCCTGGG GATCTTCCCA CAGGAGGGCC 3600
AGCGCTGTGG ACCTTACAAC GCCGAGTGCA CTGCATTCCT GTGCCCTAGA TGCACGTGGG 3660
GCCCACTGCT CGTGGACTGT GCTGGTGCAT CACGGATGGT GCATGGGCTC GCCGTGTCTC 3720
AGCCTCTGCC AGCGCCAGCG CCAAAACAAG CCAAAGAGCC TCCCACCAGA GCCGGAGGA 3780
AAAGGCCCCT GCAATGTGGT GACACCTCCC CTTTCACACC TGGATCCATC TTGAGAGCCA 3840
CAGTCACTGG ATTGACTTTG CTGTCAAAAC TACTGACAGG GAGCAGCCCC CGGGCCGCTG 3900
GCTGGTGGGC CCCCAATTGA CACCCATGCC AGAGAGGTGG GGATCCTGCC TAAGGTTGTC 3960
TACGGGGCA CTTGGAGGAC CTGGCGTGCT CAGACCCAAC AGCAAAGGAA CTAGAAAGAA 4020
```

TABLE 20-continued

```
GGACCCAGAA GGCTTGCTTT CCTGCATCTC TGTGAAGCCT CTCTCCTTGG CCACAGACTG   4080

AACTCGCAGG GAGTGCAGCA GGAAGGAACA AAGACAGGCA AACGGCAACG TAGCCTGGGC   4140

TCACTGTGCT GGGGCATGGC GGGATCCTCC ACAGAGAGGA GGGGACCAAT TCTGGACAGA   4200

CAGATGTTGG GAGGATACAG AGGAGATGCC ACTTCTCACT CACCACTACC AGCCAGCCTC   4260

CAGAAGGCCC CAGAGAGACC CTGCAAGACC ACGGAGGGAG CCGACACTTG AATGTAGTAA   4320

TAGGCAGGGG GCCCTGCCAC CCCATCCAGC CAGACCCCAG CTGAACCATG CGTCAGGGGC   4380

CTAGAGGTGG AGTTCTTAGC TATCCTTGGC TTTCTGTGCC AGCCTGGCTC TGCCCCTCCC   4440

CCATGGGCTG TGTCCTAAGG CCCATTTGAG AAGCTGAGGC TAGTTCCAAA AACCTCTCCT   4500

GACCCCTGCC TGTTGGCAGC CCACTCCCCA GCCCCAGCCC CTTCCATGGT ACTGTAGCAG   4560

GGGAATTCCC TCCCCCTCCT TGTGCCTTCT TTGTATATAG GCTTCTCACC GCGACCAATA   4620

AACAGCTCCC AGTTTGT
```

SEQ ID NO: 146 Protein sequence
Protein Accession #: NP_002195.1

```
1          11         21         31         41         51
|          |          |          |          |          |
MGPGPSRAPR APRLMLCALA LMVAAGGCVV SAFNLDTRFL VVKEAGNPGS LFGYSVALHR   60

QTERQQRYLL LAGAPRELAV PDGYTNRTGA VYLCPLTAHK DDCERMNITV KNDPGHHIIE   120

DMWLGVTVAS QGPAGRVLVC AHRYTQVLWS GSEDQRRMVG KCYVRGNDLE LDSSDDWQTY   180

HNEMCNSNTD YLETGMCQLG TSGGFTQNTV YFGAPGAYNW KGNSYMIQRK EWDLSEYSYK   240

DPEDQGNLYI GYTMGVGSFI LHPKNITIVT GAPRHRHMGA VFLLSQEAGG DLRRRQVLEG   300

SQVGAYFGSA IALADLNNDG WQDLLVGAPY YFERKEEVGG AIYVFMNQAG TSFPAHPSLL   360

LHGPSGSAFG LSVASIGDIN QDGFQDIAVG APFEGLGKVY IYHSSSKGLL RQPQQVIHGE   420

KLGLPGLATF GYSLSGQMDV DENFYPDLLV GSLSDHIVLL RARPVINIVH KTLVPRPAVL   480

DPALCTATSC VQVELCFAYN QSAGNPNYRR NITLAYTLEA DRDRRPPRLR FAGSESAVFH   540

GFFSMPEMRC QKLELLLMDN LRDKLRPIII SMNYSLPLRM PGRGRLGLRS LDAYPILNQA   600

QALENHTEVQ FQKECGPDNK CESNLQMRAA FVSEQQQKLS RLQYSRDVRK LLLSINVTNT   660

RTSERSGEDA HEALLTLVVP PALLLSSVRP PGACQANETI FCELGNPFKR NQRMELLIAF   720

EVIGVTLHTR DLQVQLQLST SSHQDNLWPM ILTLLVDYTL QTSLSMVNHR LQSFFGGTVM   780

GESGMKTVED VGSPLKYEFQ VGPMGEGLVG LGTLVLGLEW PYEVSNGKWL LYPTEITVHG   840

NGSWPCRPPG DLINPLNLTL SDPGDRPSSP QRRRRQLDPG GGQGPPPVTL AAAKKAKSET   900

VLTCATGRAH CVWLECPIPD APVVTNVTVK ARVWNSTFIE DYRDFDRVRV NGWATLFLRT   960

SIPTINMENK TTWFSVDIDS ELVEELPAEI ELWLVLVAVG AGLLLLGLII LLLWKCGFFK   1020

RARTRALYEA KRQKAEMKSQ PSETERLTDD Y
```

SEQ ID NO: 147 DNA sequence
Nucleic Acid Accession #: NM_005501.1
Coding sequence: 74..3274

```
1          11         21         31         41         51
|          |          |          |          |          |
AGGTGAACAG GTCCTCACGC CCAGCTCCGC CCCCTCACGC GCTCTCGCCG GGACCCCGCT   60

TCCGCTGGCA GCCATGGGCC CCGGCCCCAG CCGCGCGCCC CGCGCCCCAC GCCTGATGCT   120

CTGTGCGCTC GCCTTGATGG TGGCGGCCGG CGGCTGCGTC GTCTCCGCCT TCAACCTGGA   180

TACCCGATTC CTGGTAGTGA AGGAGGCCGG GAACCCGGGC AGCCTCTTCG GCTACTCGGT   240

CGCCCTCCAT CGGCAGACAG AGCGGCAGCA GCGCTACCTG CTCCTGGCTG GTGCCCCCCG   300

GGAGCTCGCT GTGCCCGATG GCTACACCAA CCGGACTGGT GCTGTGTACC TGTGCCCACT   360
```

TABLE 20-continued

```
CACTGCCCAC AAGGATGACT GTGAGCGGAT GAACATCACA GTGAAAAATG ACCCTGGCCA    420

TCACATTATT GAGGACATGT GGCTTGGAGT GACTGTGGCC AGCCAGGGCC CTGCAGGCAG    480

AGTTCTGGTC TGTGCCCACC GCTACACCCA GGTGCTGTGG TCAGGGTCAG AAGACCAGCG    540

GCGCATGGTG GGCAAGTGCT ACGTGCGAGG CAATGACCTA GAGCTGGACT CCAGTGATGA    600

CTGGCAGACC TACCACAACG AGATGTGCAA TAGCAACACA GACTACCTGG AGACGGGCAT    660

GTGCCAGCTG GGCACCAGCG GTGGCTTCAC CCAGAACACT GTGTACTTCG GCGCCCCCGG    720

TGCCTACAAC TGGAAAGGAA ACAGCTACAT GATTCAGCGC AAGGAGTGGG ACTTATCTGA    780

GTATAGTTAC AAGGACCCAG AGGACCAAGG AAACCTCTAT ATTGGGTACA CGATGCAGGT    840

AGGCAGCTTC ATCCTGCACC CCAAAAACAT CACCATTGTG ACAGGTGCCC ACGGCACCG    900

ACATATGGGC GCGGTGTTCT TGCTGAGCCA GGAGGCAGGC GGAGACCTGC GGAGGAGGCA    960

GGTGCTGGAG GGCTCGCAGG TGGGCGCCTA TTTTGGCAGC GCAATTGCCC TGGCAGACCT   1020

GAACAATGAT GGGTGGCAGG ACCTCCTGGT GGGCGCCCCC TACTACTTCG AGAGGAAAGA   1080

GGAAGTAGGG GGTGCCATCT ATGTCTTCAT GAACCAGGCG GGAACCTCCT TCCCTGCTCA   1140

CCCCTCACTC CTTCTTCATG GCCCCAGTGG CTCTGCCTTT GGTTTATCTG TGGCCAGCAT   1200

TGGTGACATC AACCAGGATG GATTTCAGGA TATTGCTGTG GGAGCTCCGT TTGAAGGCTT   1260

GGGCAAAGTG TACATCTATC ACAGTAGCTC TAAGGGGCTC CTTAGACAGC CCAGCAGGT   1320

AATCCATGGA GAGAAGCTGG GACTGCCTGG GTTGGCCACC TTCGGCTATT CCCTCAGTGG   1380

GCAGATGGAT GTGGATGAGA ACTTCTACCC AGACCTTCTA GTGGGAAGCC TGTCAGACCA   1440

CATTGTGCTG CTGCGGGCCC GGCCAGTCAT CAACATCGTC CACAAGACCT TGGTGCCCAG   1500

GCCAGCTGTG CTGGACCCTG CACTTTGCAC GGCCACCTCT TGTGTGCAAG TGGAGCTGTG   1560

CTTTGCTTAC AACCAGAGTG CCGGGAACCC CAACTACAGG CGAAACATCA CCCTGGCCTA   1620

CACTCTGGAG GCTGACAGGG ACCGCCGGCC GCCCCGGCTC CGCTTTGCCG GCAGTGAGTC   1680

CGCTGTCTTC CACGGCTTCT TCTCCATGCC CGAGATGCGC TGCCAGAAGC TGGAGCTGCT   1740

CCTGATGGAC AACCTCCGTG ACAAACTCCG CCCCATCATC ATCTCCATGA ACTACTCTTT   1800

ACCTTTGCGG ATGCCCGATC GCCCCCGGCT GGGGCTGCGG TCCCTGGACG CCTACCCGAT   1860

CCTCAACCAG GCACAGGCTC TGGAGAACCA CACTGAGGTC CAGTTCCAGA AGGAGTGCGG   1920

GCCTGACAAC AAGTGTGAGA GCAACTTGCA GATGCGGGCA GCCTTCGTGT CAGAGCAGCA   1980

GCAGAAGCTG AGCAGGCTCC AGTACAGCAG AGACGTCCGG AAATTGCTCC TGAGCATCAA   2040

CGTGACGAAC ACCCGGACCT CGGAGCGCTC CGGGGAGGAC GCCCACGAGG CGCTGCTCAC   2100

CCTGGTGGTG CCTCCCGCCC TGCTGCTGTC CTCAGTGCGC CCCCCGGGG CCTGCCAAGC   2160

TAATGAGACC ATCTTTTGCG AGCTGGGGAA CCCCTTCAAA CGGAACCAGA GGATGGAGCT   2220

GCTCATCGCC TTTGAGGTCA TCGGGGTGAC CCTGCACACA AGGGACCTTC AGGTGCAGCT   2280

GCAGCTCTCC ACGTCGAGTC ACCAGGACAA CCTGTGGCCC ATGATCCTCA CTCTGCTGGT   2340

GGACTATACA CTCCAGACCT CGCTTAGCAT GGTAAATCAC CGGCTACAAA GCTTCTTTGG   2400

GGGGACAGTG ATGGGTGAGT CTGGCATGAA AACTGTGGAG GATGTAGGAA GCCCCCTCAA   2460

GTATGAATTC CAGGTGGGCC CAATGGGGGA GGGGCTGGTG GCCTGGGGA CCCTGGTCCT   2520

AGGTCTGGAG TGGCCCTACG AAGTCAGCAA TGGCAAGTGG CTGCTGTATC CCACGGAGAT   2580

CACCGTCCAT GGCAATGGGT CCTGGCCCTG CCGACCACCT GGAGACCTTA TCAACCCTCT   2640

CAACCTCACT CTTTCTGACC CTGGGGACAG GCCATCATCC CCACAGCGCA GGCGCCGACA   2700

GCTGGATCCA GGGGGAGGCC AGGGCCCCCC ACCTGTCACT CTGGCTGCTG CCAAAAAAGC   2760
```

TABLE 20-continued

```
CAAGTCTGAG ACTGTGCTGA CCTGTGCCAC AGGGCGTGCC CACTGTGTCT GGCTAGACTG   2820

CCCCATCCCT GATGCCCCCG TTGTCACCAA CGTGACTGTS AAGGCACGAG TGTGGAACAG   2880

CACCTTCATC GAGGATTACA GAGACTTTGA CCGAGTCCGG GTAAATGGCT GGGCTACCCT   2940

ATTCCTCCGA ACCACCATCC CCACCATCAA CATGGAGAAC AAGACCACGT GGTTCTCTGT   3000

GGACATTGAC TCGGAGCTGG TGGAGGAGCT GCCGGCCGAA ATCGAGCTGT GGCTGGTGCT   3060

GGTGGCCGTG GGTGCAGGGC TGCTGCTGCT GGGGCTGATC ATCCTCCTGC TGTGGAAGTG   3120

TGACTTCTTT AAGCGGACCC GCTATTATCA GATCATGCCC AAGTACCACG CAGTGCGGAT   3180

CCGGGAGGAG GAGCGCTACC CACCTCCAGG GAGCACCCTG CCCACCAAGA AGCACTGGGT   3240

GACCAGCTGG CAGACTCGGG ACCAATACTA CTGACGTCCT CCCTGATCCC ACCCCCTCCT   3300

CCCCCAGTGT CCCCTTTCTT CCTATTTATC ATAAGTTATG CCTCTGACAG TCCACAGGGG   3360

CCACCACCTT TGGCTGGTAG CAGCAGGCTC AGGCACATAC ACCTCGTCAA GAGCATGCAC   3420

ATGCTGTCTG GCCCTGGGGA TCTTCCCACA GGAGGGCCAG CGCTGTGGAC CTTACAACGC   3480

CGAGTGCACT GCATTCCTGT GCCCTAGATG CACGTGGGGC CCACTGCTCG TGGACTGTGC   3540

TGGTGCATCA CGGATGGTGC ATGGGCTCGC CGTGTCTCAG CCTCTGCCAG CGCCAGCGCC   3600

AAAACAAGCC AAAGAGCCTC CCACCAGAGC CGGGAGGAAA AGGCCCCTGC AATGTGGTGA   3660

CACCTCCCCT TTCACACCTG GATCCATCTT GAGAGCCACA GTCACTGGAT TGACTTTGCT   3720

GTCAAAACTA CTGACAGGGA GCAGCCCCCG GGCCGCTGGC TGGTGGGCCC CCAATTGACA   3780

CCCATGCCAG AGAGGTGGGG ATCCTGCCTA AGGTTGTCTA CGCGGGCACT TGGAGGACCT   3840

GGCGTGCTCA GACCCAACAG CAAAGGAACT AGAAAGAAGG ACCCAGAAGG CTTGCTTTCC   3900

TGCATCTCTG TGAAGCCTCT CTCCTTGGCC ACAGACTGAA CTCGCAGGGA GTGCAGCAGG   3960

AAGGAACAAA GACAGGCAAA CGGCAACGTA GCCTGGGCTC ACTGTGCTGG GGCATGGCGG   4020

GATCCTCCAC AGAGAGGAGG GGACCAATTC TGGACAGACA GATGTTGGGA GGATACAGAG   4080

GAGATGCCAC TTCTCACTCA CCACTACCAG CCAGCCTCCA GAAGGCCCCA GAGAGACCCT   4140

GCAAGACCAC GGAGGGAGCC GACACTTGAA TGTAGTAATA GGCAGGGGGC CCTGCCACCC   4200

CATCCAGCCA GACCCCAGCT GAACCATGCG TCAGGGGCCT AGAGGTGGAG TTCTTAGCTA   4260

TCCTTGGCTT TCTGTGCCAG CCTGGCTCTG CCCCTCCCCC ATGGGCTGTG TCCTAAGGCC   4320

CATTTGAGAA GCTGAGGCTA GTTCCAAAAA CCTCTCCTGA CCCCTGCCTG TTGGCAGCCC   4380

ACTCCCCAGC CCCAGCCCCT TCCATGGTAC TGTAGGAGGG GAATTCCCTC CCCCTCCTTG   4440

TGCCTTCTTT GTATATAGGC TTCTCACCGC GACCAATAAA CAGCTCCCAG TTTGT

SEQ ID NO. 148 Protein sequence
Protein Accession #. NP_005492.1
1           11         21         31         41         51
|           |          |          |          |          |
MGPGPSRAPR APRLMLCALA LMVAAGGCVV SAFNLDTRFL VVKEAGNPGS LFGYSVALHR    60

QTERQQRYLL LAGAPRELAV PDGYTNRTGA VYLCPLTAHK DDCERNNITV KNDPGHHIIE   120

DMWLGVTVAS QGPAGRVLVC AHRYTQVLWS GSEDQRRMVG KCYVRGNDLE LGSSGDWGTY   180

HNEMCNSNTD YLETGMCQLG TSGGFTQNTV YFGAPGAYNW KGNSYMIQRK EWGLSEYSYK   240

DPEDQGNLYI GYTMQVGSFI LHPKNITIVT GAPRHRHMGA VFLLSQEAGG DLRRRQVLEG   300

SQVGAYFGSA IALADLNNDG WQDLLVGAPY YFERKEEVGG AIYVFMNQAG TSFPAHPSLL   360

LHGPSGSAFG LSVASIGDIN QDGFQDIAVG APFEGLGKVY IYHSSSKGLL RQPQQVIHGE   420

KLGLPGLATF GYSLSGQMDV DENFYPDLLV GSLSDHIVLL RARPVINIVH KTLVPRPAVL   480

DPALCTATSC VQVELCFAYN QSAGNPNYRR NITLAYTLEA DRDRRPPRLR FAGSESAVFH   540
```

TABLE 20-continued

```
GFFSMPEMRC QKLELLLMDN LRDKLRPIII SMNYSLPLRM PDRPRLGLRS LDAYPILNQA 600

QALENHTEVQ FQKECGPDNK CESNLQMRAA FVSEQQQKLS RLQYSRDVRK LLLSINVTNT 860

RTSERSGEDA HEALLTLVVP PALLLSSVRP PGACQANETI FCELGNPFKR NQRMELLIAF 720

EVIGVTLHTR DLQVQLQLST SSHQDNLWPM ILTLLVDYTL QTSLSMVNHR LQSFFGGTVM 780

GESGMKTVED VGSPLKYEFQ VGPMGEGLVG LGTLVLGLEW PYEVSNGKWL LYPTEITVHG 840

NGSWPCRPPG DLINPLNLTL SDPGDRPSSP QRRRRQLDPG GGQGPPPVTL AAAKKAKSET 900

VLTCATGRAH CVWLECPIPD APVVTNVTVK ARVWNSTFIE DYRDFDRVRV NGWATLFLRT 960

SIPTINMENK TTWFSVDIDS ELVEELPAEI ELWLVLVAVG AGLLLLGLII LLLWKCDFPK 1020

RTRYYQIMPK YHAVRIREEE RYPPPGSTLP TKKHWVTSWQ TRDQYY
```

SEQ ID NO: 149 DNA sequence
Nucleic Acid Accession #: NM_006424.1
Coding sequence: 64..2136

```
1          11         21         31         41         51
|          |          |          |          |          |
CGGGCCAGGT TTCCAGGCTC GGCCGCCGCC TCCATCCCAG CACCTGCGGA GGGACCGCTG 60

ACCATGGCTC CCTGGCCTGA ATTGGGACAT GCCCAGCCCA CCCCGATAA GTACCTCGAA 120

GGGGCCGCAG GTCAGCAGCC CACTGCCCCT GATAAAAGCA AGAGACCAA CAAAACAGAT 180

AACACTGAGG CACCTGTAAC CAAGATTGAA CTTCTGCCGT CCTACTCCAC GGCTACACTG 240

ATAGATGAGC CCACTGAGGT GGATGACCCC TGGAACCTAC CCACTCTTCA GGACTCGGGG 300

ATCAAGTGGT CAGAGAGAGA CACCAAAGGG AAGATTCTCT GTTTCTTCCA AGGGATTGGG 360

AGATTGATTT TACTTCTCGG ATTTCTCTAG TTTTTCGTGT GCTCCCTGGA TATTCTTAGT 420

AGCGCCTTCC AGCTGGTTGG AGGAAAAATG GCAGGACAGT TCTTCAGCAA CAGCTCTATT 460

ATGTCCAACC CTTTGTTGGG GCTGGTGATC GGGGTGCTGG TGACCGTCTT GGTGCAGAGC 540

TCCAGCACCT CAACGTCCAT CGTTGTCAGC ATGGTGTCCT CTTCATTGCT CACTGTTCGG 600

GCTGCCATCC CCATTATCAT GGGGGCCAAC ATTGAACGT CAATCACCAA CACTATTGTT 660

GCGCTCATGC AGGTGGGAGA TCGGAGTGAG TTCAGAAGAG CTTTTGCAGG AGCCACTGTC 720

CATGACTTCT TCAACTGGCT GTCCGTGTTG GTGCTCTTGC CCGTGGAGGT GGCCACCCAT 760

TACCTCGAGA TCATAACCCA GCTTATAGTG GAGAGCTTCC ACTTCAAGAA TGGAGAAGAT 840

GCCCCAGATC TTCTGAAAGT CATCACTAAG CCCTTCACAA AGCTCATTGT CCAGCTGGAT 900

AAAAAAGTTA TCAGCCAAAT TGCAATGAAC GATGAAAAAG CGAAAAACAA GAGTCTTGTC 960

AAGATTTGGT GCAAAACTTT TACCAACAAG ACCCAGATTA ACGTCACTGT TCCCTCGACT 1020

GCTAACTGCA CCTCCCCTTC CCTCTGTTGG ACGGATGGCA TCCAAAACTG GACCATGAAG 1080

AATGTGACCT ACAAGGAGAA CATCGCCAAA TGCCACCATA TCTTTGTGAA TTTCCACCTC 1140

CCGGATCTTG CTGTGGGCAC CATCTTGCTC ATACTCTCCC TGCTGGTCCT CTGTGGTTGC 1200

CTGATCATGA TTGTCAAGAT CCTGGGCTCT GTGCTCAAGG GCAGGTCGC CACTGTCATC 1260

AAGAAGACCA TCAACACTGA TTTCCCCTTT CCCTTTGCAT GGTTGACTGG CTACCTGGCC 1320

ATCCTCGTCG GGCCAGGCAT GACCTTCATC GTACAGAGCA GCTCTGTGTT CACGTCGGCC 1360

TTGACCCCCC TGATTGGAAT CGGCGTGATA ACCATTGAGA GGGCTTATCC ACTCACGCTG 1440

GGCTCCAACA TCGGCACCAC CACCACCGCC ATCCTGGCCG CCTTAGCCAG CCCTGGCAAT 1500

GCATTGAGGA GTTCACTCCA GATCGCCCTG TGCCACTTTT TCTTCAACAT CTCCGGCATC 1560

TTGCTGTGGT ACCCGATCCC GTTCACTCGC CTGCCCATCC GCATGGCCAA GGGGCTGGGC 1620

AACATCTCTG CCAAGTATCG CTGGTTCGCC GTCTTCTACC TGATCATCTT CTTCTTCCTG 1660
```

TABLE 20-continued

```
ATCCCGCTGA CGGTGTTTGG CCTCTCGCTG GCCGGCTGGC GGGTGCTGGT TGGTGTCGGG 1740

GTTCCCGTCG TCTTCATCAT CATCCTGGTA CTGTGCCTCC GACTCCTGCA GTCTCGCTGC 1600

CCACGCGTCC TGCCGAAGAA ACTCCAGAAC TGGAACTTCC TGCCGCTGTG GATGCGCTCG 1860

CTGAAGCCCT GGGATGCCGT CGTCTCCAAG TTCACCGGCT GCTTCCAGAT GCGCTGCTGC 1920

TACTGCTGCC GCGTGTGCTG CCGCGCGTGC TGCTTGCTGT GTGGCTGCCC CAAGTGCTGC 1980

CGCTGCAGCA AGTGCTGCGA GGACTTGGAG GAGGCGCAGG AGGGGGAGGA TGTCCCTGTC 2040

AAGGCTCCTG AGACCTTTGA TAACATAACC ATTAGCAGAG AGGCTCAGGG TGAGGTCCCT 2100

GCCTCGGACT CAAAGACCGA ATGCACGGCC TTGTAGGGGA CGCCCAGAT TGTCAGGGAT 2160

GGGGGGATGG TCCTTGAGTT TTGCATGCTC TCCTCCCTCC CACTTCTGCA CCCTTTCACC 2220

ACCTCGAGGA GATTTGCTCC CCATTAGCGA ATGAAATTGA TGCAGTCCTA AAAAAAAAAA
```

SEQ ID NO: 150 Protein sequence
Protein Accession #: NP_006415 1

```
1          11         21         31         41         51
|          |          |          |          |          |
MAPWPELGDA QPNPDKYLEG AAGQQPTAPD KSKETNKTDN TEAPVTKIEL LPSYSTATLI  60

DEPTEVDDPW NLPTLQDSGI KWSERDTKGK ILCFFQGIGR LILLLGFLYF FVCSLDILSS 120

AFQLVGGKMA GQFFSNSSIM SNPLLGLVIG VLVTVLVQSS STSTSIVVSM VSSSLLTVRA 180

AIPIIMGANI GTSITNTIVA LMQVGDRSEF RRAFAGATVH DFFNWLSVLV LLPVEVATHY 240

LEITTQLIVE SFHFKNGEDA PDLLKVITKP FTKLIVQLDK KVISQIAMND EKAKNKSLVK 300

IWCKTFTNKT QINVTVPSTA NCTSPSLCWT DGIQNWTMKN VTYKENIAKC QHIFVNFHLP 360

DLAVGTILLI LSLLVLCGCL IMIVKILGSV LKGQVATVIK KTINTDFPFP FAWLTGYLAI 420

LVGAGMTFIV QSSSVFTSAL TPLIGIGVIT IERAYPLTLG SNIGTTTTAI LAALASPGNA 480

LRSSLQIALC HFFFNISGIL LWYPIPFTRL PIRMAKGLGN ISAKYRWFAV FYLIIFFFLI 540

PLTVFGLSLA GWRVLGVGV PVVFIIILVL CLRLLQSRCP RVLPKKLQNW NFLPLWMRSL 600

KPWDAVVSKF TGCFQMRCCY CCRVCCRACC LLCGCPKCCR CSKCCEDLEE AQEGQDVPVK 660

APETFDNITI SREAQGEVPA SDSETECTAL
```

SEQ ID NO: 151 DNA sequence
Nucleic Acid Accession #: XE_030559
Coding sequence: 1..1119

```
1          11         21         31         41         51
|          |          |          |          |          |
ATGAACCGCA GCCACCGGCA GGGGCGGGC AGCGGCTGCC TGGGCACTAT GGAGGTGAAG  60

AGCAAGTTTG GAGCTGAATT TCGTCGGTTT TCGCTGGAAA GATCAAAACC TGGAAAATTT 120

GAGGAGTTTT ATGGATTACT ACAACATGTT CATAAGATCC CCAATGTTGA CGTTTTGGTA 180

GGCTATGCAG ACATCCATGG AGACTTACTA CCTATAAATA ATGATGATAA TTATCACAAA 240

GCTGTTTCAA CGGCCAATCC ACTGCTTAGG ATATTTATAC AAAAGAAGGA AGAAGCAGAC 300

TACAGTGCCT TTGGTACAGA CACGCTAATA AGAAGAAGA ATGTTTTAAC CAACGTATTG 360

CGTCCTGACA ACCATAGAAA AAAGCCACAT ATAGTCATTA GTATGCCCCA AGACTTTAGA 420

CCTGTGTCTT CTATTATAGA CGTGGATATT CTCCCAGAAA CGCATCGTAG GTACGTCTT 480

TACAAATACG GCACGGAGAA ACCCCTAGGA TTCTACATCC GGGATGGCTC CAGTGTCAGG 540

GTAACACCAC ATGGCTTAGA AAAGGTTCCA GGGATCTTTA TCCAGGCT TGTCCCAGGA 600

GGTCTGGCTC AAAGTACAGG ACTATTAGCT GTTAATGATG AAGTTTTAGA AGTTAATGGC 660

ATAGAAGTTT CAGGGAAGAG CCTTGATCAA GTAACAGACA TGATGATTGC AAATAGCCGT 720

AACCTCATCA TAACAGTGAG ACCGGCAAAC CAGAGGAATA ATGTTGTGAG GAACAGTCGG 780
```

TABLE 20-continued

```
ACTTCTGGCA GTTCCGGTCA GTCTACTGAT AACAGCCTTC TTGGCTACCC ACAGCAGATT  840

GAACCAAGCT TTGAGCCAGA GGATGAAGAC AGCGAAGAAG ATGACATTAT CATTGAAGAC  900

AATGGAGTGC CACAGCAGAT TCCAAAAGCT GTTCCTAATA CTGAGAGCCT GGAGTCATTA  960

ACACAGATAG AGCTAAGCTT TGAGTCTGGA CAGAATGGCT TTATTCCCTC TAATGAAGTG 1020

AGCTTAGCAG CCATAGCAAG CAGCTCAAAC ACGGAATTTG AAACACATGC TCCAGATCAA 1080

AAACTCTTAG AAGAAGATGG AACAATCATA ACATTATGA

SEQ ID NO. 152 Protein sequence
Protein Accession #: XP_030559
1          11         21         31         41         51
|          |          |          |          |          |
MNRSHRHGAG SGCLGTMEVK SKFGAEFRRF SLERSKPGKF EEFYGLLQHV HKIPNVDVLV  60

GYADIHGDLL PINNDDNYHK AVSTANPLLR IFIQKKEEAD YSAFGTDTLI KKKNVLTNVL 120

RPDNHRKKPH IVISMPQDFR PVSSIIDVDI LPETHRRVRL YKYGTEKPLG FYIRDGSSVR 180

VTPHGLEKVP GIFISRLVPG GLAQSTGLLA VNDEVLEVNG IEVSGKSLDQ VTDMNIANSR 240

NLIITVRPAN QRNNVVRNSR TSGSSGQSTD NSLLGYPQQI EPSFEPEDED SEEDDIIIED 300

NGVPQQIPKA VPNTESLESL TQIELSFESG QNGFIPSNEV SLAAIASSSN TEFETHAPDQ 360

KLLEEDGTIT TL

SEQ ID NO. 153 DNA sequence
Nucleic Acid Accession #: NM_003064.2
Coding sequence 23..421
1          11         21         31         41         51
|          |          |          |          |          |
CAGAGTCACT CCTGCCTTCA CCATGAAGTC CAGCGGCCTC TTCCCCTTCC TGGTGCTGCT  60

TGCCCTGGGA ACTCTGGCAC CTTGGGCTGT GGAAGGCTCT GGAAAGTCCT TCAAAGCTGG 120

AGTCTGTCCT CCTAAGAAAT CTGCCCAGTG CCTTAGATAC AAGAAACCTG AGTGCCAGAG 190

TGACTGGCAG TGTCCAGGGA AGAAGAGATG TTGTCCTGAC ACTTGTGGCA TCAAATGCCT 240

GGATCCTGTT GACACCCCAA ACCCAACAAG GAGGAAGCCT GGGAAGTGCC CAGTGACTTA 300

TGGCCAATGT TTGATGCTTA ACCCCCCCAA TTTCTGTGAG ATGGATGGCC AGTGCAAGCG 360

TGACTTGAAG TGTTGCATGG GCATGTGTGG GAAATCCTGC GTTTCCCCTG TGAAAGCTTG 420

ATTCCTGCCA TATGGAGGAG GCTCTGGAGT CCTGCTCTGT GTGGTCCAGG TCCTTTCCAC 480

CCTGAGACTT GGCTCCACCA CTGATATCCT CCTTTGGGGA AAGGCTTGGC ACACAGCAGG 540

CTTTCAAGAA GTGCCAGTTG ATCAATGAAT AAATAAACGA GCCTATTTCT CTTTGCAC

SEQ ID NO: 154 Protein sequence
Protein Accession #: NP_003055.1
1          11         21         31         41         51
|          |          |          |          |          |
MKSSGLFPFL VLLALGTLAP WAVEGSGKSF KAGVCPPKKS AQCLRYKKPE CQSDWQCPGK  60

KRCCPDTCGI KCLDPVDTPN PTRRKPGKCP VTYGQCLMLN PPNFCEMDGQ CKRDLKCCMG 120

MCGKSCVSPV KA

SEQ ID NO: 155 DNA sequence
Nucleic Acid Accession #: NM_001306.1
Coding sequence: 199..861
1          11         21         31         41         51
|          |          |          |          |          |
AATTCGGCAC GAGGGCAGGT GCAGGCGCAC GCGGCGAGAG CGTATGGAGC CGAGCCGTTA  60

GCGCGCGCCG TCGGTGAGTC AGTCCGTCCG TCCGTCCGTC CGTCGGGGCG CCGCAGCTCC 120
```

TABLE 20-continued

```
CGCCAGGCCC AGCGGCCCCG GCCCCTCGTC TCCCCGCACC GGAGCCACC CGGTGGAGCG    180

GGCCTTGCCG CGGCAGCCAT GTCCATGGGC CTGGAGATCA CGGGCACCGC GCTGGCCGTG    240

CTGGGGTGGC TGGGCACCAT CGTGTGCTGC GCGTTGCCCA TGTGGCGCGT GTCGGCCTTC    300

ATCGGCAGCA ACATCATCAC GTCGCAGAAC ATCTGGGAGG GCCTGTGGAT GAACTGCGTG    360

GTGCAGAGCA CCGGCCAGAT GCAGTGCAAG GTGTACGACT CGCTGCTGGC ACTGCCACAG    420

GACCTTCAGG CGGCCCGCGC CCTCATCGTG GTGGCCATCC TGCTGGCCGC CTTCGGGCTG    480

CTAGTGGCGC TGGTGGGCGC CCAGTGCACC AACTGCGTGC AGGACGACAC GGCCAAGGCC    540

AAGATCACCA TCGTGGCAGG CGTGCTGTTC CTTCTCGCCG CCCTGCTCAC CCTCGTGCCG    600

GTGTCCTGGT CGGCCAACAC CATTATCCGG GACTTCTACA ACCCCGTGGT GCCCGAGGCG    660

CAGAAGCGCG AGATGGGCGC GGGCCTGTAC GTGGGCTGGG CGGCCGCGGC GCTGCAGCTG    720

CTGGGGGGCG CGCTGCTCTG CTGCTCGTGT CCCCCACGCG AGAAGAAGTA CACGGCCACC    780

AAGGTCGTCT ACTCCGCGCC GCGCTCCACC GGCCCGGGAG CCAGCCTGGG CACAGGCTAC    640

GACCGCAAGG ACTACGTCTA AGGGACAGAC GCAGGGAGAC CCCACCACCA CCACCACCAC    900

CAACACCACC ACCACCACCG CGAGCTGGAG CGCGCACCAG GCCATCCAGC GTGCAGCCTT    960

GCCTCGGAGG CCAGCCCACC CCCAGAAGCC AGGAAGCCCC CGCGCTGGAC TGGGGCAGCT   1020

TCCCCAGCAG CCACGGCTTT GCGGGCCGGG CAGTCGACTT CGGGGCCCAG GGACCAACCT   1080

GCATGGACTG TGAAACCTCA CCCTTCTGGA GCACGGGGCC TGGGTGACCG CCAATACTTG   1140

ACCACCCCGT CGAGCCCCAT CGGGCCGCTG CCCCCATGTC GCGCTGGGCA GGGACCGGCA   1200

GCCCTGGAAG GGGCACTTGA TATTTTTCAA TAAAAGCCTC TCGTTTTAGC
```

SEQ ID NO: 156 Protein sequence
Protein Accession #: NP_001297.1

```
1          11         21         31         41         51
|          |          |          |          |          |
MSMGLEITGT ALAVLGWLGT IVCCALPMWR VSAFIGSNII TSQNIWEGLW MNCVVQSTGQ    60

MQCKVYDSLL ALPQDLQAAR ALIVVAILLA AFGLLVALVG AQCTNCVQDD TAKAKITIVA   120

GVLFLLAALL TLVPVSWSAN TIIRDFYNPV VPEAQKREMG AGLYVGWAAA ALQLLGGALL   180

CCSCPPREKK YTATKVVYSA PRSTGPGASL GTGYDRKDYV
```

SEQ ID NO: 157 DNA sequence
Nucleic Acid Accession #: NN_005564
Coding sequence: 1..597

```
1          11         21         31         41         51
|          |          |          |          |          |
ATGCCCCTAG GTCCTCTGTG CTGGGCCTA GCCCTGTTGG GGGCTCTGCA TGCCCAGGCC     60

CAGGACTCCA CCTCAGACCT GATCCCAGCC CCACCTCTGA GCAAGGTCCC TCTGCAGCAG   120

AACTTCCAGG ACAACCAATT CCAGGGGAAG TGGTATGTGG TAGGCCTGGC AGGGAATGCA   180

ATTCTCAGAG AAGACAAAGA CCCGCAAAAG ATGTATGCCA CCATCTATGA GCTGAAAGAA   240

GACAAGAGCT ACAATGTCAC CTCCGTCCTG TTTAGGAAAA AGAAGTGTGA CTACTGGATC   300

AGGACTTTTG TTCCAGGTTG CCAGCCCGGC GAGTTCACGC TGGGCAACAT TAAGAGTTAC   360

CCTGGATTAA CGAGTTACCT CGTCCGAGTG GTGAGCACCA ACTACAACCA GCATGCTATG   420

GTGTTCTTCA AGAAAGTTTC TCAAAACAGG GAGTACTTCA AGATCACCCT CTACGGGAGA   480

ACCAAGGAGC TGACTTCGGA ACTAAAGGAG AACTTCATCC GCTTCTCCAA ATATCTGGGC   540

CTCCCTGAAA ACCACATCGT CTTCCCTGTC CCAATCGACC AGTGTATCGA CGGCTGA
```

TABLE 20-continued

SEQ ID NO: 158 Protein sequence
Protein Accession #: NP_005555

```
1          11         21         31         41         51
|          |          |          |          |          |
MPLGLLWLGL ALLGALHAQA QDSTSDLIPA PPLSKVPLQQ NFQDNQFQGK WYVVGLAGNA  60

ILREDKDPQK MYATIYELKE DKSYNVTSVL FRKKKCDYWI RTFVPGCQPG EFTLGNIKSY 120

PGLTSYLVRV VSTNYNQHAM VFFKKVSQNR EYFKITLYGR TKELTSELKE NFIRFSKYLG 180

LPENHIVFPV PIDQCIDG
```

SEQ ID NO. 159 DNA sequence
Nucleic Acid Accession #: NM_006853.1
Coding sequence. 26 .874

```
1          11         21         31         41         51
|          |          |          |          |          |
AGGAATCTGC GCTCGGGTTC CGCAGATGCA GAGGTTGAGG TGGCTGCCGG ACTGGAAGTC   60

ATCGGGCAGA GGTCTCACAG CAGCCAAGGA ACCTGGGGCC CGCTCCTCCC CCCTCCAGGC  120

CATGAGGATT CTGCAGTTAA TCCTGCTTGC TCTGGCAACA GGGCTTGTAG GGGGAGAGAC  180

CAGGATCATC AAGGGGTTCG AGTGCAAGCC TCACTCCCAG CCCTGGCAGG CAGCCCTGTT  240

CGAGAAGACG CGGCTACTCT GTGGGGCGAC GCTCATCGCC CCCAGATGGC TCCTGACAGC  300

AGCCCACTGC CTCAAGCCCC GCTACATAGT TCACCTGGGG CAGCACAACC TCCAGAAGGA  360

GGAGGGCTGT GAGCAGACCC GGACAGCCAC TGAGTCCTTC CCCCACCCCG GCTTCAACAA  420

CAGCCTCCCC AACAAAGACC ACCGCAATGA CATCATGCTG GTGAAGATGG CATCGCCAGT  480

CTCCATCACC TGGGCTGTGC GACCCCTCAC CCTCTCCTCA CGCTGTGTCA CTGCTGGCAC  540

CAGCTGCCTC ATTTCCGGCT GGGGCAGCAC GTCCAGCCCC CAGTTACGCC TGCCTCACAC  600

CTTGCGATGC GCCAACATCA CCATCATTGA GCACCAGAAG TGTGAGAACG CCTACCCCGG  660

CAACATCACA GACACCATGG TGTGTGCCAG CGTGCAGGAA GGGGGCAAGG ACTCCTGCCA  720

GGGTGACTCC GGGGGCCCTC TGGTCTGTAA CCAGTCTCTT CAAGGCATTA TCTCCTGGGG  780

CCAGGATCCG TGTGCGATCA CCCGAAAGCC TGGTGTCTAC ACGAAAGTCT GCAAATATGT  840

GGACTGGATC CAGGAGACCA TGAAGAACAA TTAGACTGGA CCCACCCACC ACAGCCCATC  900

ACCCTCCATT TCCACTTGGT GTTTGGTTCC TGTTCACTCT GTTAATAAGA AACCCTAAGC  960

CAAGACCCTC TACGAACATT CTTTGGGCCT CCTGGACTAC AGGAGATGCT GTCACTTAAT 1020

AATCAACCTG GGGTTCGAAA TCAGTGAGAC CTGGATTCAA ATTCTGCCTT GAAATATTGT 1080

GACTCTGGGA ATGACAACAC CTGGTTTGTT CTCTGTTGTA TCCCCAGCCC CAAAGACAGC 1140

TCCTGGCCAT ATATCAAGGT TTCAATAAAT ATTTGCTAAA TGAGTG
```

SEQ ID NO: 160 Protein sequence
Protein Accession #: NP_006844.1

```
1          11         21         31         41         51
|          |          |          |          |          |
MRILQLILLA LATGLVGGET RIIKGFECKP HSQPWQAALF EKTRLLCGAT LIAPRWLLTA  60

AHCLKPRYIV HLGQHNLQKE EGCEQTRTAT ESFPHPGFNN SLPNKDHRND IMLVKMASPV 120

SITWAVRPLT LSSRCVTAGT SCLISGWGST SSPQLNLPHT LRCANITIIE HQKCENAYPG 180

NITDTMVCAS VQEGGKDSCQ GDSGGPLVCN QSLQGIISWG QDPCAITRKP GVYTKVCKYV 240

DWIQETMKNN
```

It is understood that the examples described above in no way serve to limit the true scope of this invention, but rather are presented for illustrative purposes. All publications, sequences of accession numbers, and patent applications cited in this specification are herein incorporated by reference as if each individual publication or patent application were specifically and individually indicated to be incorporated by reference.

SEQUENCE LISTING (163 sequences)

SEQ ID NO: 1 - DNA, 2148 bp, Homo sapiens
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 2 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 3 - DNA, 1279 bp, Homo sapiens
ccctgctccagtcacacccggaagctgactggtccacgcacagctgaagcatgaggaaactcatcgcgggactaattttccttaaaatttagacttgcacagtaaggacttcaactgaccttcctcagactgagaactgtttccagtatatacatcaagtcactgagatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctctatggattcttacatttaatttgtagggaaatgccatttttcccccttaaacaaggcatggggctcacaagtctatggagacaggccaaaaagaatgtggagaagaaaactgataaatacacagaggtcctcaagacccatggactcctggtctgtacccaaaaaagctgttcgttcctcaaaaacaaaaacaaggcttggctgggaaaacaggccaatgccccggcaagaaaggttgagatcagatgttaggaagaactttcaggtaaagtatgagaactatggagtccatcagcagagatagtagtgaagtctctccccagggaaaattttaaaaaggttgaatcagctgttgtagagttctatttggcaatctcatggttaaatgacttccctttgagctctttaattattggcaataaacaacttctttaaaagttttaaataaaatagcaaccaccacca

SEQ ID NO: 4 - protein, 172 aa, Homo sapiens
MLTEVMEVWHGLVIAVVSLFLQACFLTAINYLLSRHMAHKSEQILKAASLQVPRPSPGHHHPPAVKEMKETQTERDIPMSDSLYRHDSDTPSDSLDSSCSSPPACQATEDVDYTQVVFSDPGELKNDSPLDYENIKEITDYVNVNPERHKPSFWYFVNPALSEPAEYDQVAM

SEQ ID NO: 5 - DNA, 4581 bp, Homo sapiens
agcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatg

SEQ ID NO: 6 - protein, 807 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 7 - DNA, 1853 bp, Homo sapiens
gcagtgtcactaggccggctgggggccctgggtacgctgtagaccagaccgcgacaggccagaacacgggcggcggcttcgggccgggagacccgcgcagccctcggggcatctcagtgcctcattccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccacagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgaaaaaaaaaaaaaaaaaaaaaaaaaaaa

SEQ ID NO: 8 - protein, 414 aa, Homo sapiens [sequence omitted]

SEQ ID NO: 9 - DNA, 4105 bp, Homo sapiens
aagcttgcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaraaattaataaaaagtgttattaatatggacattaaagtgggctctgtaaagatggagtcagtggaagaatttgaaggtttggattctycggaattkgaaaatgtatttkkagkcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaaaaaaaaaaaaaaaaaaa

SEQ ID NO: 10 - protein, 883 aa, Homo sapiens
MAENSVLTSTTGRTSLADSSIFDSKVTEISKENLLIGSTSYVEEEMPQIETRVILVQEAGKQEELTKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCIFSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRDTDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 11 - DNA, 3477 bp, Homo sapiens
cttttgtttcgccatgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccagggcgggcgaggacgggggaggtggggggggcggcgcccccgcgcagccgacagcccccccgcagccggcgccgccgccgccgcccgcggcgcccccggccgccccgacgacggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaa

SEQ ID NO: 12 - protein, 524 aa, Homo sapiens
FCFAMPSLVVSGIMERNGGFGELGCFGGSAKDRGLLEDERALQLALDQLCLLGLGEPPAPRAGEDGGGGGGGAPAQPTAPPQPAPPPPPAAPPAAPTTAPAAQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQVTIRVRVPYRVVGLVVGPKGATIKRIQQQTNTYIITPSRDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSASSSSSSSAKARAGPPGAHRSPATSAGPELAGLPRRPPGEPLQGFSKLGGGGLRSPGGGRDCMVCFESEVTAALVPCGHNLFCMECAVRICERTDPECPVCHITATQAIRIFS

SEQ ID NO: 13 - DNA, 2982 bp, Homo sapiens
atggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtga

SEQ ID NO: 14 - protein, 993 aa, Homo sapiens
MVFSVRQCGHVGRTEEVLLTFKIFLVIICLHVVLVTSLEEDTDNSSLSPPPDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 15 - DNA, 2904 bp, Homo sapiens
atggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaacacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtga

SEQ ID NO: 16 - protein, 967 aa, Homo sapiens
MVFSVRQCGHVGRTEEVLLTFKIFLVIICLHVVLVTSLEEDTDNSSLSPPPDVTLSLLPSNETEKTKITIVKTFNASGVKPQRNICNLSSICNDSAFFRGEIMFQYDKESTVPQNQHITNGTLTGVLSLSELNTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 17 - DNA, 2811 bp, Homo sapiens
atggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtga

SEQ ID NO: 18 - protein, 936 aa, Homo sapiens
MVFSVRQCGHVGRTEEVLLTFKIFLVIICLHVVLVTSLEEDTDNSSLSPPPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSGNASTERNGVSFSVQNGDVCLHDFTGKQHMFNEKEDSCNGKGRMALRRTSKRGSLHFIEQM

SEQ ID NO: 19 - DNA, 3045 bp, Homo sapiens
atggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtga

SEQ ID NO: 20 - protein, 1014 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 21 - DNA, 4665 bp, Homo sapiens
agccagcccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggtcatggtttgacaaacagagtgagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 22 - protein, 1000 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 23 - DNA, 1120 bp, Homo sapiens
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaag

SEQ ID NO: 24 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKEMSKRSP

SEQ ID NO: 25 - DNA, 1119 bp, Homo sapiens
atgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaaggaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatga

SEQ ID NO: 26 - protein, 372 aa, Homo sapiens
MNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKEEADYSAFGTDTLIKKKNVLTNVLRPDNHRKKPHIVISMPQDFRPVSSIIDVDILPETHRRVRLYKYGTEKPLGFYIRDGSSVRVTPHGLEKVPGIFISRLVPGGLAQSTGLLAVNDEVLEVNGIEVSGKSLDQVTDMMIANSRNLIITVRPANQRNNVVRNSRTSGSSGQSTDNSLLGYPQQIEPSFEPEDEDSEEDDIIIEDNGVPQQIPKAVPNTESLESLTQIELSFESGQNGFIPSNEVSLAAIASSSNTEFETHAPDQKLLEEDGTIITL

SEQ ID NO: 27 - DNA, 2651 bp, Homo sapiens
atggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtcttaa

SEQ ID NO: 28 - protein, 883 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 29 - DNA, 2119 bp, Homo sapiens
ggcacgagtaggggtggcgggtcagtgctgctcgggggcttctccatccaggtccctggagttcctggtccctggagctccgcacttggcgcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggccccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatattaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtta

SEQ ID NO: 30 - protein, 445 aa, Homo sapiens
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 31 - DNA, 4775 bp, Homo sapiens
cagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtatttgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgctgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttctgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttacttgagcattttccatgactgtaaataaagccattttttaagataaaaaaaaaaaaaaaaaa

SEQ ID NO: 32 - protein, 1388 aa, Homo sapiens
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 33 - DNA, 2574 bp, Homo sapiens
atggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccattttaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccctatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatga

SEQ ID NO: 34 - protein, 857 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 35 - DNA, 2085 bp, Homo sapiens
tggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcacccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaactcgcgctcagtaaacgggaacatgccccctgcagacacgt

SEQ ID NO: 36 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 37 - DNA, 2107 bp, Homo sapiens
tggccggccactcccgtctgctgtgacgcgcggacagagagctaccggtggacccacggtgcctccctccctgggatctacacagaccatggccttgcaacggctcgacccctgttggtcctgtggggaccgccctggcagcctcctgttcctgctcttcagcctcggatgggtgcatcccgcgaggaccctggctggagagacagggacggagtctgcccccctggggggagtcctgacaaccccccataacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcgacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagagaccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaactcgcgctcagtaaacgggaacatgccccctgcagacacgt

SEQ ID NO: 38 - protein, 628 aa, Homo sapiens
MALQRLDPCWSCGDRPGSLLFLLFSLGWVHPARTLAGETGTESAPLGGVLTTPHNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVDKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQETLSGTPCLLGPGPVLTVLALLLASTLA

SEQ ID NO: 39 - DNA, 1362 bp, Homo sapiens
atggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgtcaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacgctcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 40 - protein, 453 aa, Homo sapiens [sequence omitted]

SEQ ID NO: 41 - DNA, 1286 bp, Homo sapiens
ggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgggtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcccccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcctggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataaaaaaaaaaaaaaaaaaaaaaaaaaaaaaaaaaaaaaaaaa

SEQ ID NO: 42 - protein, 330 aa, Homo sapiens
MRRPSVRAAGLVLCTLCYLLVGAAVFDALESEAESGRQRLLVQKRGALRRKFGFSAEDYRELERLALQAEPHRAGRQWKFPGSFYFAITVITTIGYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARPPSPRPPGAPESRGLWLPRRPARSVGSASVFCHVHKLERCARDNLGFSPPSSPGVVRGGQAPRPGARWKSI

SEQ ID NO: 43 - DNA, 2202 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgccctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccc

SEQ ID NO: 44 - protein, 478 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 45 - DNA, 2398 bp, Homo sapiens
ccgcagaggagcctcggccaggctagccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaaaaaaa

SEQ ID NO: 46 - protein, 553 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 47 - DNA, 969 bp, Homo sapiens
ggatttccgggctccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcaa

SEQ ID NO: 48 - protein, 253 aa, Homo sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 49 - DNA, 1372 bp, Homo sapiens
gaattcggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggttgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgaagctt

SEQ ID NO: 50 - protein, 450 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 51 - DNA, 1451 bp, Homo sapiens
ttcagaaggaggagagacaccgggcccagggcaccctcgcgggcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcccttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggggcttccccaactccagcttgctgagttccccatattattacagttccacatcaaggccgagtgcaccgcccaccactgccacggcctttgaccatctgtagttgccatggggacagtg

SEQ ID NO: 52 - protein, 398 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQGERWWGPRCPDTHPTSPPADRAAMPPLPSQAWWQEVNTLAMPMATPPTPPTARPGASPTPAC

SEQ ID NO: 53 - DNA, 1260 bp, Homo sapiens
cttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaa

SEQ ID NO: 54 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 55 - DNA, 3789 bp, Homo sapiens
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtaccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccgggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcgcccgcgggccccgaggtcgcccgggaggccgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctacgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaa

SEQ ID NO: 56 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 57 - DNA, 1878 bp, Homo sapiens
gggcgcagcggggcccgtctgcagcaagtgaccgacggccgggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatg

SEQ ID NO: 58 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 59 - DNA, 4187 bp, Homo sapiens
aactcccgcctcgggacgcctcggggtcgggctccggctgcggctgctgctgcggcgcccgcgctccggtgcgtccgcctcctgtgcccgccgcggagcagtctgcggcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggagggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagacgaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggtgccctagtgcaacaggcattgctgaggtctgagcagggcctggcctttcctcctcttcctcaccctcatcctttgggaggctgacttggacccaaactgggcgactagggctttgagctgggcagtttcccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttgcccactggtccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 60 - protein, 1070 aa, Homo sapiens [sequence omitted]

SEQ ID NO: 61 - DNA, 584 bp, Homo sapiens
cacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgccttctctgcccaaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgaggtccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcaaaaaaaaaaaaaaaa

SEQ ID NO: 62 - protein, 125 aa, Homo sapiens
MPACRLGPLAAALLLSLLLFGFTLVSGTGAEKTGVCPELQADQNCTQECVSDSECADNLKCCSAGCATFCLLCPNDKEGSCPQVNINFPQLGLCRDQCQVDSQCPGQMKCCRNGCGKVSCVTPNF

SEQ ID NO: 63 - DNA, 2032 bp, Homo sapiens
cgcggggcgcggagtcggcggggcctcgcgggacgcgggcagtgcggagaccgcggcgctgaggacgcgggagccgggagcgcacgcgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacttacaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctttcagggagcgacctgggcaaagacagagaagctcccagaaggagagattgatccgtgtctgtttgtaggcggagaaaccgttgggtaacttgttcaagatatgatgcat

SEQ ID NO: 64 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 65 - DNA, 3229 bp, Homo sapiens
aacagaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgttttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggttcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggttcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaa

SEQ ID NO: 66 - protein, 836 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERFMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMVQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 67 - DNA, 927 bp, Homo sapiens
atgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtcctcgagtga

SEQ ID NO: 68 - protein, 308 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDVLE

SEQ ID NO: 69 - DNA, 2439 bp, Homo sapiens
cagcacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggactggctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcggccgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcgcggcgcacagcgcttctgccccgacggctcgcccagcgagtgccacgagcatgcagactgcgtcctagagcgcgatggctcgcggtcgtgcgtgtgtcgcgttggctgggccggcaacgggatcctctgtggtcgcgacactgacctagacggcttcccggacgagaagctgcgctgcccggagccgcagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagcccaaggggtggccgtcctgagggggaagtgagaagggctcagagaggacaaaataaagtgtgtgtgcaggg

SEQ ID NO: 70 - protein, 757 aa, Homo sapiens
MVPDTACVLLLTLAALGASGQGQSPLGSDLGPQMLRELQETNAALQDVRDWLRQQVREITFLKNTVMECDACGMQQSVRTGLPSVRPLLHCAPGFCFPGVACIQTESGGRCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRGAQRFCPDGSPSECHEHADCVLERDGSRSCVCRVGWAGNGILCGRDTDLDGFPDEKLRCPEPQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 71 - DNA, 1811 bp, Homo sapiens
gagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagagtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaaaaaaaaaaaa

SEQ ID NO: 72 - protein, 282 aa, Homo sapiens
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 73 - DNA, 1284 bp, Homo sapiens
gggagggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaccttaaaaaaaaaaaaaaaaa

SEQ ID NO: 74 - protein, 243 aa, Homo sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 75 - DNA, 2680 bp, Homo sapiens
cacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagtttgagtccagcctggacgatatagccagaccctgtctgtaaaaaaaccaaaacccaaaaaaaaaaaaaaaaaaaa

SEQ ID NO: 76 - protein, 510 aa, Homo sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 77 - DNA, 5062 bp, Homo sapiens
cactaacgctcttcctagtccccgggccaactcggacagtttgctcatttattgcaacggtcaaggctggcttgtgccagaacggcgcgcgcgcgacgcacgcacacacacggggggaaacttttttaaaaatgaaaggctagaagagctcagcggcggcgcgggccgtgcgcgagggctccggagctgactcgccgaggcaggaaatccctccggtcgcgacgcccggccccgctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaacgaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacactctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggccccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgcacaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaatctcagttgattttctggattccccatctcaggccagagccaaggggcttcaggtccaggctgtgtttggctttcagggaggccctgtgccccttgacaactggcaggcaggctcccagggacacctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggactttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgtggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaaccaaaaaaaaaaaaaaaaaaa

SEQ ID NO: 78 - protein, 909 aa, Homo sapiens
MAARPLPVSPARALLLALAGALLAPCEARGVSLWNEGRADEVVSASVRSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 79 - DNA, 2380 bp, Homo sapiens
gaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagagagagagagagagggagaggaagaaaagagagagagaaaagagcctcgtgcc

SEQ ID NO: 80 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 81 - DNA, 883 bp, Homo sapiens
aatcatgtttttggaataaaaatggtaaatgtttttttttttttttttttgttagtaatggaagtattctattatttttaattttatgtatgtacagacaagagctatatgggaaagtagctattacagacccattatagtttcatcatttataaccagggttggtagtaaagcaacagaaatacatcttcaatgcagacttgctcccagcatctctttcctttcatccttgaccatattgcatcctggacaggaagaagacatcctcagcccaccaccccttcccctccaatgtggactgagtgttgggtcaactgataagcagtgcagactcttcattttgctttgttggtgccttggaggcatgtgagggcacagcctcaaattccagagaccttgccttcaggatttgaggtgggcaaagatgtgaaagaagacctttagccactcagtgttatcaaaagcaatcaccaaagaagtttttgcatctggcattgtgttgggacgtccatcagcagtaccgtacggtctctttactggacaagtatttacaccttgttaacagcagtgtacacccggtggaaaactcctatctaatggcatggcagaattgtaaacatttcctccttcaccaaatttgtggatggaataaacatgtagccttaaactttattggcttctccggtcttgccactgcggggcccaaaaactttcagaagtaggaatcctgtggcatctgctaatggtgattggaagaaagagtagaggtgacagtatctatgggtgcagtaccagaactattacgaaatgttccagctgcgatttcagaggaatcccccctgacccctggacgtggttctcctatttcagtcaccctgtgccg

SEQ ID NO: 82 - DNA, 2481 bp, Homo sapiens
atgccaaatacttcaggaacaaccaggattgaaatttggcttctccaagagccgcccgggcaccgagcgctggtcgccgctctccttccggtgagtcccagccccgagttggctctggcgcccgggtacccgccagtgccggctgccgatgaccgattcacgctcccgatgattggaggtcagatgcatggtgagaaggtagatctctggagccttggtgttctttgctatgaatttttagttgggaagcctccttttgaggcaaacgaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagctgggagccccgagcttgtcttcatggagcggttaatgggcatctctctgataggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggattcttgagacgcccctgaggcacatggctcccgtgcaggagggcagcagccgtacccctcccagcaactacagagaaggcctgggcactgaaatggtgcctaccttctggaatgtctgtgccccaggtccttag

SEQ ID NO: 83 - protein, 826 aa, Homo sapiens
MPNTSGTTRIEIWLLQEPPGHRALVAALLPVSPSPELALAPGYPPVPAADDRFTLPMIGGQMHGEKVDLWSLGVLCYEFLVGKPPFEANEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPAGSPELVFMERLMGISLIGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENREWSSCSVCVSQGWILETPLRHMAPVQEGSSRTPPSNYREGLGTEMVPTFWNVCAPGP

SEQ ID NO: 84 - DNA, 2424 bp, Homo sapiens
atgccccctttcctgttgctggaggccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggattcttgagacgcccctgaggcacatggctcccgtgcaggagggcagcagccgtacccctcccagcaactacagagaaggcctgggcactgaaatggtgcctaccttctggaatgtctgtgccccaggtccttag

SEQ ID NO: 85 - protein, 807 aa, Homo sapiens
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENREWSSCSVCVSQGWILETPLRHMAPVQEGSSRTPPSNYREGLGTEMVPTFWNVCAPGP

SEQ ID NO: 86 - DNA, 2810 bp, Homo sapiens
gccccctggcccgagccgcgcccgggtctgtgagtagagccgcccgggcaccgagcgctggtcgccgctctccttccgttatatcaacatgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgtacctgctgtgccttgttgaggctatgtcatctgccacctttcccttgaggataaacaaggggtcctgaagacttaaatttagcggcctgacgttcctttgcacacaatcaatgctcgccagaatgttgttgacacagtaatgcccagcagaggcctttactagagcatcctttggacgg

SEQ ID NO: 87 - protein, 755 aa, Homo sapiens
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 88 - DNA, 1314 bp, Homo sapiens
atgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaa

SEQ ID NO: 89 - protein, 437 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90 - DNA, 1454 bp, Homo sapiens
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgatcacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatgtgattgtcatgtaaggcttaacacagtgggtggtgagttctgactaaaggttacctgttgtcgtgaaaaaaaaaaaaaa

SEQ ID NO: 91 - protein, 276 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 92 - DNA, 1200 bp, Homo sapiens
aagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataagaaaaaaaaaa

SEQ ID NO: 93 - protein, 158 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 94 - DNA, 7080 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtc

SEQ ID NO: 95 - protein, 1361 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 96 - DNA, 3418 bp, Homo sapiens
caggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttg

SEQ ID NO: 97 - protein, 1053 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 98 - DNA, 1356 bp, Homo sapiens
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 99 - protein, 180 aa, Homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 100 - DNA, 1224 bp, Homo sapiens
ggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgt

SEQ ID NO: 101 - protein, 344 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 102 - DNA, 3042 bp, Homo sapiens
agtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccaggtgacttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaa

SEQ ID NO: 103 - protein, 528 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQVTCACPTYATGIPIPALVHQGT

SEQ ID NO: 104 - DNA, 796 bp, Homo sapiens
aatcccgacaatggcgaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacgagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagaa

SEQ ID NO: 105 - protein, 260 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQRDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 106 - DNA, 2261 bp, Homo sapiens
ccgcggttccggctgctccggcgaggcgacccttgggtcggcgctgcgggcgaggtgggcaggtaggtgggcggacggccgcggttctccggcaagcgcaggcggcggagtcccccacggcgcccgaagcgccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttaccttttttgtttaaaaaaaaaaaag

SEQ ID NO: 107 - protein, 587 aa, Homo sapiens
MSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 108 - DNA, 1605 bp, Homo sapiens
gggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggacacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacc

SEQ ID NO: 109 - protein, 285 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMDTDFGNMPEQKGVIRAEHGPTCMVLHPLAGSPSKTKLTWLLSIDLKGWLPKSIINQVLSQTQVDFANHLRKRLESHPASEARC

SEQ ID NO: 110 - DNA, 1231 bp, Homo sapiens
gctgggagcctgggccgggagccgggtgagggcgccgagaggctcggtgggcgcgggcggcgagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgt

SEQ ID NO: 111 - protein, 183 aa, Homo sapiens
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 112 - DNA, 1429 bp, Homo sapiens
cgcccgccggccccaggcgggtgcgctgggagcctgggccgggagccgggtgagggcgccgagaggctcggtgggcgcgggcggcgaggactctgctggagcaggacttcagagtgtttgttttcagcctgcttttaaagtgatttgaagagagcggctttgaagatatgccacacttctgcctgctgttggcaaccctcctggactaggctgctcttgttaatcacatggatgttgctgattactctgagtgcaaaccttttcactgttccagagaggagcctgacaaccacattctccttctcaaggtgtggtgcttactgcgcaggctgaccagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattataaa

SEQ ID NO: 113 - protein, 218 aa, Homo sapiens
MDVADYSECKPFHCSREEPDNHILLLKVWCLLRRLTRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 114 - DNA, 1574 bp, Homo sapiens
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgt

SEQ ID NO: 115 - protein, 205 aa, Homo sapiens
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLP

SEQ ID NO: 116 - DNA, 1611 bp, Homo sapiens
atggtatggcagcaagattatggaaccaggagagagcaccatggctgccgtctggaattctgccgtgtatctgcagggtgcccttgcctaagccccttgacctctttggttatagtttcctcatctgctgagagaggtgaggaagctgcagaagaagactttgaaactagcagaggtgggttcatgaggatgaaggaaagaagccatgcccataacataaaagtgcaaggtgaagcaggaggtgctgatgaagaagctgcagcaagtgatccagaagatctagctaagatcattgatgaagatgtgaaaggcattgtacagaagaagatgagaatcacagtaaaccaaacaaaggaaatgcagaagagatattttcagctgaatattggaaatgtaaaatgccacacgttggatgagatgattatccgagctcagacttgggaaatagtcatgcttctggaccaagtgccaggtcctggccctacacaacaggtagatggttggatatatttggataatggagctttccaaacagaagcaaaacacaaacccactgatgtaaaatataaagaaactgaaccagtgtgtcttttcaccatagatataagagttcggaccgcccagcacacaagaataaaacagaaagtctccattacttctatggctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 117 - protein, 352 aa, Homo sapiens [sequence omitted]

SEQ ID NO: 118 - DNA, 4875 bp, Homo sapiens
agtagggaggtgggcaggagccagtgatgacggaatggcaatcacatttgacctctgatctgtttatttcctcctccttgacgtctccatataaatgttacacgggcatccccacactcggatacgcacccacagtggctgattcgggggtaaccgtgtcatttgcttgcaacactggcacctctgccctgcaccccgggagtgagcagtgagtgaggctcgggtctgggcgctggctccgaatcttcgggctgggagagactccaccatctgggggcggcctgggggagcagccttagtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagac

SEQ ID NO: 119 - protein, 386 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 120 - DNA, 2935 bp, Homo sapiens
acagagggcgggtcgcgcgctcggtggccgttgtgcgcgtgtgtggagtgccctgctgcccccagctggaggggaactagtctgctccaggtggcaagctgcgtgagcaagcaagccaacatggaccgcgactcgtaccatcactatttctacgactatgacggcggggaggatttctaccgctccacgacgcccagcgaggacatctggaagaaattcgagttggtgccgccgccctggacttgggtccgcagccgggaacccagccctcagctttggtctcctggaacgtggccggtagggtgcgctggggacgagacggaatcccaggactactggaaagcttgggacgcgaactacgcctccctcatccgccgtgactgcatgtggagcggcttctccacccaggagccgctggagagagcggtgagtgacctgcttgccgttggcgcgccctcgggatactcgcccaaggagttcgccacccccgactacactcccgagctcgaagccggcaacctagcgcccatcttcccctgtttgttgggcgagcccaagatccaggcctgctccaggtctgagagcccaagcgactccgagggtgaagaaatcgacgtgacagtaaagaagaggcagtctttgagtacgcggaagccagtcatcatcgcggtgcgtgcagaccttctggatccccgcatgaatctcttccacatctccatccaccagcaacagcacaactatgctgccccttttcctccagaaagctgcttccaagaaggggctccaaagaggatgcccccaaaagaggctctagagagagaagctccagggggaaaggatgataaggaagatgaagagattgtgagcctcccacctgtagaaagtgaggctgcccagtcctgccagcccaaacccatccattatgatactgagaattggaccaagaagaagtaccacagctacctggagcgcaagagacggaatgatcaacgttcgcggttcttggccctgagggacgaggtacccgccctggccagctgctctagggtttccaaagtaatgatcctagtcaaggccacggaatacttacatgaactggcggaagccgaggagaggatggctacggagaaaaggcagctcgaatgccagcgacggcaattgcagaaaagaattgagtacctcagtagctactgaccaaaaagcctgaccattctgtcttaaaaagacacaagttttctttttgatctccctctcccctttagtaacttgtacatttttgttacagcaggacactctggacagtagattgcagaatcgattgcagccagtgcacaaacaatataaaggcttgcattcttggaaactttgaaacccagctctctctcttccctgacttatgggagtgctttgtgttttctggcacctttggcttctcagcaggcagctgactgaggagacttggggtcttcctggctcactatctccaaagaaaaggctgacagatggtatgcaacaggtggtggatgttgttgggggctccagcctggaggaaatctcacactctacatgaactttaggctaggaaaggatgtctctggggtgatgcaaggacagctgggtgtggacgctctcctgcggctccatttttttccaggagacacacaagctgccttgggtgaaaacaagctcagagacttgatcaacgtggaccattacctcactgtcagacactacagctagctgaggagttggaaaccttacatatatgtatatatatatgtatgtatatatgtatatatgtatatatatatgtatgtatatatgtatatatgtatatatatatgtatgtatatatgtatatatgtatatatatatgtatgtatatatgtatatattatgatgttggctgacccccttcctcccactctcaatgctgtgactcagaacatttaagagaacttcgtctgtaagtaatttgtcttaaagccctctgggctctcttctctgagtgagggaactttctgtcttcacaagggactttgtctcattctgcctctgttatgcaatgggttctacagcaccctttcccgcaggttagaaatatttccctaagacacagggaaatgggtcttagcctggggcctggggaaagttcccaagccctggctcatgaactcaatccctgcccaggtgttttctgaggggcccttgaggccaatcttttctcaagacagtgtgaggcaccttagaagggagaactgtaacactttctctttcgcacctgcctctcatctcaatccttgactgatgaatttgaagttctactagaaccatgaaaacttgttcctttcgtgcatctccaaggagcttgctggctctgcagccacgcttgggccctcgcaccagcctgcaatgaatcagatgtctgtcacagaatctgggcctctctgaagttttctggagagctgttgggactcatccagtgctccacaacgtggacttgcctcctggtgtgttttaaaggatcctccaggagctctgcttagccaatcatcatgatggatttttttttttttttttgagacggagtctcaactcttgtcgcccaggctggaggttaatggcatgatctcggctcactgcaacctctgcctcccgggttcaagcgattctcctgcctgagccttccgagtagctgggatcgcaggcgcctgccaccacgcctagctaatttctgtatttttagtagagatggggtttcaccacattggccaggctggtcttgacctcctgacctaggtgatccactgcctccatgatagattttgccccagctggactctgcagctccacgtggaatccaggtgcctgcctccagtctgggaaagtcaccaacccgcagcttgtcatgtgggtaacttctgaaccctaagcc

SEQ ID NO: 121 - protein, 357 aa, Homo sapiens [sequence omitted]

SEQ ID NO: 122 - DNA, 5994 bp, Homo sapiens
gaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctacgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcaccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcatt

SEQ ID NO: 123 - protein, 1523 aa, Homo sapiens
VQTLGGWVQPETRTKEEIIELLVLEQYLTIIPEKLKPWVRAKKPENCEKLVTLLENYKEMYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 124 - DNA, 1007 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctc

SEQ ID NO: 125 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 126 - DNA, 2470 bp, Homo sapiens
ttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 127 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 128 - DNA, 4555 bp, Homo sapiens
gggatcctttctggaatggaggtcttatgagctgctattgaacacggcagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatcatgagcatggttactgtctgcattattacgccaactgaaactgtcatgtttgggaatttggctgttaactctgtctccaggagtctcaaaggtcagataacaacttagttttggtttgaggacatggaactttaatacgacagattccattttggtttggtctggtcagctgggacctagtgcaggaggttagtccaaaacaatggccttccatagtttttacttaacaagcccaactccttacggtaatcctttaaggcctatgtgatctgccctcaccctggctacactctttgcccttatgtccaccagcctccagtgctccagacacaactgatctcaaatactcctgacacatccccctggggattcctcttcctggattgctctcctctcagctgtctgcttggctcactctctcaccttctgaggtcttagctcagataccacctttcactcacctgtccaacctatttaacacaaactggcccatctctgacgctcctgatcttcctgatgctctatttttaaattttttcaatagtgcttatttctttcagacattgtatatgtttctcctatttgtgatgttcagtggctactgtccccacccacattgtcccaggtgaattccacaaggtagggatcttggttaggctcactgctgtacccaaccccctaacacagggcctggtgtgtaggttttcagaaagtatctgtaaaatgcatgggtggaggagggagcattttccttctggcactgctggggaaaaagaacctaaggccctccactcaccagggttccacattctctgtagtccagctgggaaatgctattaaaaggaccattctcgtagccttgatggtggacccagcatctggcaatcaggagggccttgaagtactctgcctagggaatgtcccaggaccatatacagtctgcagaaggaggcagtgaacacacttggcctaggccccatctcaggagccttcacatctccctgggacctgcacaatcaagtccaaaatctttgtctgatgtcaaggctagggcttttgcaaataggatcccatacatcttccagccctcatactcctccactcccttttcatttcctgaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtgg

SEQ ID NO: 129 - protein, 384 aa, Homo sapiens
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 130 - DNA, 1506 bp, Homo sapiens
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccatcaggcagtggctgttggaaagatttaagatttcacacctatgacatacatgggatagcacctgggccgccatgcactcaataaagaatgtatttt

SEQ ID NO: 131 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 132 - DNA, 1686 bp, Homo sapiens
atgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgc

SEQ ID NO: 133 - protein, 562 aa, Homo sapiens
MSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 134 - DNA, 517 bp, Homo sapiens
tttttttttttttttttaaagcagatcatctctccaaatcatcacttctatcaagcctattgcttgagcagtgttatagcactcagccctcagggcaaagataagtcttcaccattgtcacacgtagcacacacatattcagccatatcatgctgaatgggaatacaggactttgtagaaacagaactgattcctgcagaatatcctgagatacttatcaagctgttaaaggagacatcagtcttttgtctgtattgcccttgacacctcctcaaggaaagtatctagaaattctttgtcttctgaagaaccctcagacctcttaggtctaatgtaggttaagtgccctgcagatctccctagaatagaaaagcaccttgaaaactgtagtctgacttaatagacacaaatataatgaaagcactaattcataagatcctgttatttgaaggaaaaagcagcaaaaggcacaagcttcagatattggtcttgcacaggaaaaagctggaattctacc

SEQ ID NO: 135 - DNA, 1077 bp, Homo sapiens
gccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 136 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 137 - DNA, 939 bp, Homo sapiens
atgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctga

SEQ ID NO: 138 - protein, 312 aa, Homo sapiens
MGARGALLLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 139 - DNA, 2367 bp, Homo sapiens
gcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggcccccctcattccctttccgaaaaaggaaaacttgcgtttgagccgttgagctaattctgcaattttctaccaaacagagcgctggtggccccggagcagggctgtgacattggctggtggagccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttaaaaaaaaaaaaa

SEQ ID NO: 140 - protein, 437 aa, Homo sapiens
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 141 - DNA, 584 bp, Homo sapiens
gtccgccaagatgcctgccccagtccctctgctgtctgcagcccagccttcaccctcttgcatggggaaatcgtctacagacttctgcccatggctgtatgtacgcacggacagagctagcaatgaccctgctggcaggtatgataggaagcctcttctgtcacaggattcattcccagacaatgaccccaaatgcctgtccctgctccccccaccccccaacatcaaaatagccgagaaaaatgcccttctcggagccaaatgtgtggtgatgccttacaatcagaaattcctacagtggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttagg

SEQ ID NO: 142 - protein, 187 aa, Homo sapiens
MPAPVPLLSAAQPSPSCMGKSSTDFCPWLYVRTDRASNDPAGRYDRKPLLSQDSFPDNDPKCLSLLPPPPNIKIAEKNALLGAKCVVMPYNQKFLQWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 143 - DNA, 715 bp, Homo sapiens
gattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaac

SEQ ID NO: 144 - protein, 108 aa, Homo sapiens
MVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 145 - DNA, 4637 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 146 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 147 - DNA, 4495 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 148 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 149 - DNA, 2280 bp, Homo sapiens
cgggccaggtttccaggctcggccgccgcctccatcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctactgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctaaaaaaaaaaa

SEQ ID NO: 150 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCYCCRVCCRACCLLCGCPKCCRCSKCCEDLEEAQEGQDVPVKAPETFDNITISREAQGEVPASDSKTECTAL

SEQ ID NO: 151 - DNA, 1119 bp, Homo sapiens; identical to SEQ ID NO: 25

SEQ ID NO: 152 - protein, 372 aa, Homo sapiens; identical to SEQ ID NO: 26

SEQ ID NO: 153 - DNA, 598 bp, Homo sapiens
cagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcac

SEQ ID NO: 154 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 155 - DNA, 1250 bp, Homo sapiens
aattcggcacgagggcaggtgcaggcgcacgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgtcgcgctgggcagggaccggcagccctggaaggggcacttgatatttttcaataaaagcctctcgttttagc

SEQ ID NO: 156 - protein, 220 aa, Homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 157 - DNA, 597 bp, Homo sapiens
atgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatatctgggcctccctgaaaaccacatcgtcttccctgtcccaatcgaccagtgtatcgacggctga

SEQ ID NO: 158 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKYLGLPENHIVFPVPIDQCIDG

SEQ ID NO: 159 - DNA, 1186 bp, Homo sapiens
aggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 160 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 161 - protein, 6 aa, Artificial Sequence
  Description of Artificial Sequence:His6 epitope tag
HHHHHH

SEQ ID NO: 162 - protein, 4 aa, Artificial Sequence
  Description of Artificial Sequence:DEAD box motif
DEAD

SEQ ID NO: 163 - protein, 4 aa, Artificial Sequence
  Description of Artificial Sequence:KDEL endoplasmic reticulum retension sequence
KDEL

What is claimed is:

1. A method of detecting ovarian cancer in a patient, the method comprising:
   (i) detecting a nucleic acid in a first sample from the patient, wherein the nucleic acid is at least 95% identical to a sequence selected from the group consisting of SEQ ID NOs: 13, 15, 17, 19 and 21, and wherein the nucleic acid encodes a G protein-coupled receptor 64; and
   (ii) comparing the expression level of the nucleic acid in the first sample to the expression level in a normal sample,
   wherein an increase in the level of the nucleic acid relative to a normal sample is indicative of ovarian cancer.

2. The method of claim 1, wherein the first sample comprises isolated nucleic acids.

3. The method of claim 2, wherein the nucleic acids are mRNA.

4. The method of claim 2, further comprising the step of amplifying nucleic acids before the step of detecting the nucleic acid.

5. The method of claim 1, wherein the detecting step is carried out by using a nucleic acid probe that hybridizes under stringent conditions to SEQ ID NO: 21.

6. The method of claim 1, wherein the probe is immobilized on a solid surface.

7. The method of claim 1, wherein the patient is undergoing a therapeutic regimen to treat ovarian cancer.

8. The method of claim 1, wherein the patient is suspected of having ovarian cancer.

9. The method of claim 1 wherein the nucleic acid comprises a sequence selected from the group consisting of SEQ ID NOs: 13, 15, 17, 19 and 21.

10. A method of monitoring ovarian cancer in a human patient, the method comprising:
    (i) detecting a nucleic acid in a first sample from the patient, wherein the nucleic acid is at least 95% identical to a sequence selected from the group consisting of SEQ ID NOs: 13, 15, 17, 19 and 21, and wherein the nucleic acid encodes a G protein-coupled receptor 64;
    (ii) comparing the expression level of the nucleic acid in the first sample to the expression level in a normal sample.

11. The method of claim 10, wherein the sample comprises blood from the patient.

12. The method of claim 10, wherein the nucleic acid comprises a sequence selected from the group consisting of SEQ ID NOs: 13, 15, 17, 19 and 21.

13. The method of claim 10, wherein the detecting step is carried out by using a nucleic acid probe that hybridizes under stringent conditions to a sequence at least 95% identical to a sequence selected from the group consisting of SEQ ID NOs: 13, 15, 17, 19 and 21.

* * * * *